United States Patent
Budde et al.

(10) Patent No.: US 10,677,795 B2
(45) Date of Patent: Jun. 9, 2020

(54) MARKER SEQUENCES FOR THE DIAGNOSIS AND STRATIFICATION OF SYSTEMIC SCLEROSIS PATIENTS

(71) Applicant: PROTAGEN AG, Dortmund (DE)

(72) Inventors: Petra Budde, Dortmund (DE); Dieter Zucht, Hannover (DE); Angelika Lüking, Bochum (DE); Matthias Schneider, Düsseldorf (DE)

(73) Assignee: Protagen AG, Dortmund (DE)

( * ) Notice: Subject to any disclaimer, the term of this patent is extended or adjusted under 35 U.S.C. 154(b) by 137 days.

(21) Appl. No.: 15/309,886

(22) PCT Filed: May 11, 2015

(86) PCT No.: PCT/EP2015/060396
§ 371 (c)(1),
(2) Date: Nov. 9, 2016

(87) PCT Pub. No.: WO2015/169973
PCT Pub. Date: Nov. 12, 2015

(65) Prior Publication Data
US 2018/0017554 A1    Jan. 18, 2018

(30) Foreign Application Priority Data

May 9, 2014   (EP) .................... 14167807

(51) Int. Cl.
*G01N 33/564* (2006.01)
*G01N 33/60* (2006.01)

(52) U.S. Cl.
CPC ........... *G01N 33/564* (2013.01); *G01N 33/60* (2013.01); *G01N 2500/04* (2013.01); *G01N 2800/10* (2013.01); *G01N 2800/52* (2013.01)

(58) Field of Classification Search
None
See application file for complete search history.

(56) References Cited

U.S. PATENT DOCUMENTS

| | | | | |
|---|---|---|---|---|
| 2008/0045469 | A1* | 2/2008 | Cao | C07K 14/52 514/44 R |
| 2014/0371098 | A1* | 12/2014 | Luking | G01N 33/57415 506/9 |

FOREIGN PATENT DOCUMENTS

| | | |
|---|---|---|
| WO | WO-99/57311 A2 | 11/1999 |
| WO | WO-99/57312 A1 | 11/1999 |
| WO | WO-2012/129423 A2 | 9/2012 |

OTHER PUBLICATIONS

Kuno et al. J Biol. Chem 1993, vol. 268, p. 13510-13518 (Year: 1993).*
Ashmun Blood 1992, vol. 79, p. 3344-3349 (Year: 1992).*
Green et al. Pro. Natl. Acad. Sci. 1999 vol. 96, p. 4176-4179 (Year: 1999).*
Erlenbach et al. J. Biol. Chem 2001 vol. 276, p. 29382-29392 (Year: 2001).*
Noutoshi et al. The Plant Journal 2005 vol. 43, p. 873-888 (Year: 2005).*
Bowie et al. Science, 1990 vol. 247:1306-1310 (Year: 1990).*
Albon, S., et al., "Performance of a Multiplex Assay Compared to Enzyme and Precipitation Methods for Anti-ENA Testing in Systemic Lupus and Systemic Sclerosis", Journal of Immunological Methods, 2011, vol. 365, pp. 126-131.
De Beéck, K. O.., et al., "Antinuclear Antibody Detection by Automated Multiplex Immunoassay in Untreated Patients at the Time of Diagnosis", Autoimmunity Reviews, 2012, vol. 12, pp. 137-143.
Buliard, A., et al., "Apport de la Technologie Luminex pour la Recherche Simultanée de Neuf Autoanticorps Associés aux Connectivities. Résultats d'une Étude Multicentrique", Ann. Biol. Clin., 2005, vol. 63, No. 1, pp. 51-58.
Carlsson, A., et al., "Serum Protein Profiling of Systemic Lupus Erythematosus and Systemic Sclerosis Using Recombinant Antibody Microarrays", Molecular & Cellular Proteomics, 2011, vol. 10, No. 5, 10.1074/mcp.M110.005033-13, 14 pages.
Mehra, S., et al., "Autoantibodies in Systemic Sclerosis", Autoimmunity Reviews, 2013, vol. 12, No. 3, pp. 340-354.
Mierau, R., et al., "Frequency of Disease-Associated and Other Nuclear Autoantibodies in Patients of the German Network for Systemic Scleroderma: Correlation with Characteristic Clinical Features", Arthritis Research & Therapy, 2011, vol. 13:R172, 14 pages.
Watts, R., "Autoantibodies in the Autoimmune Rheumatic Disease", Medicine, 2006, vol. 34, No. 11, pp. 441 and 444.
International Preliminary Report on Patentability for PCT/EP2015/060396 dated Nov. 15, 2016.
International Search Report for PCT/EP2015/060396 dated Dec. 16, 2015.
Hudson, M., et al., "Diagnostic Criteria of Systemic Sclerosis", Journal of Autoimmunity, 2014, vol. 48-49, pp. 38-41.
Krämer, M., et al., "Inhibition of H3K27 Histone Trimethylation Activates Fibroblasts and Induces Fibrosis", Ann. Rheum. Dis., 2013, vol. 72, pp. 614-620.

* cited by examiner

Primary Examiner — Changhwa J Cheu
(74) Attorney, Agent, or Firm — Finnegan, Henderson, Farabow, Garrett and Dunner, LLP

(57) ABSTRACT

The present invention relates to methods for identifying markers for systemic sclerosis (also referred to as scleroderma; SSc) and the markers identified with the aid of this method, which can differentiate between SSc and other autoimmune diseases on the one hand and between different SSc subgroups on the other hand. The invention also relates to panels, diagnostic devices, and test kits which comprise these markers, and also to the use and application thereof, for example for the diagnosis, prognosis and therapy control of SSc. The invention also relates to methods for screening and for validating active substances for use in SSc subgroups.

9 Claims, 11 Drawing Sheets
Specification includes a Sequence Listing.

FIG. 12 (Sensitivity and Specificity)

MARKER SEQUENCES FOR THE DIAGNOSIS AND STRATIFICATION OF SYSTEMIC SCLEROSIS PATIENTS

RELATED APPLICATIONS

This application is a national stage application (under 35 U.S.C. § 371) of PCT/EP2015/060396, filed May 11, 2015, which claims benefit of European Application No. 14167807.8, filed May 9, 2014.

SUBMISSION OF SEQUENCE LISTING

The Sequence Listing associated with this application is filed in electronic format via EFS-Web and hereby incorporated by reference into the specification in its entirety. The name of the text file containing the Sequence Listing is Sequence_Listing_074027_0035. The size of the text file is 3,545 KB, and the text file was created on Sep. 14, 2017.

The present invention relates to methods for identifying markers for systemic sclerosis (SSc; also scleroderma or synonymously Progressive Systemic Sclerosis (PSS)) and to the markers identified with the aid of this method, which can differentiate between SSc and other autoimmune diseases on the one hand and between different SSc subgroups on the other hand. The invention also relates to panels, diagnostic devices and test kits which comprise these markers, and to the use and application thereof, for example for the diagnosis, prognosis and therapy control of SSc. The invention also relates to methods for screening and for validating active substances for use in SSc subgroups.

SSc is a chronic, inflammatory, rheumatic disease, which counts among the classic immunological connective tissue diseases (collagenoses).

SSc is a heterogeneous disease with excessive fibrosis of the skin. Further organ systems, such as the lungs, gastrointestinal area, kidneys, heart and blood vessels can also be affected. In addition, joint symptoms (arthritis) also occur.

SSc is a very rare disease. The incidence is approximately 0.5-1.5/100,000 individuals/year. It mostly occurs between the ages of 30 and 50. Women are 10-15 times more likely to be affected than men (LeRoy et al. 1988).

Clinically, a distinction can be made between limited and diffuse SSc in accordance with LeRoy et al. (1988). In earlier phases of the disease, it is often difficult to classify patients unambiguously, with this being referred to as undifferentiated SSc. If, in addition to scleroderma, fundamental symptoms of other rheumatic diseases also occur, reference is made to scleroderma overlap syndrome or overlap syndrome.

The limited form of SSc occurs at a frequency of up to 60%. This is characterised by fibrosis of the hands and feet, which spreads to below the elbows and knee joints. The Raynaud phenomenon often exists already for many years prior to the appearance of skin fibrosis. Gastrointestinal changes (difficulty in swallowing) and pulmonary arterial hypertony (PAH) also often occur. The limited form also includes CREST syndrome: calcinosis cutis, Raynaud phenomenon, oesophageal dysmotility, slerodactyly, and telangiectasia.

The diffuse form is the quicker and more severe form of SSc. In this case the fibrosis spreads past the elbows over the body and face. In contrast to the limited form, skin fibroses occur already 1-2 years after the appearance of the Raynaud phenomenon.

In the case of scleroderma overlap syndrome, symptoms of further non-organ-specific autoimmune diseases, such as myositis, lupus erythematodes/SLE, Sjögren's syndrome, and rheumatoid arthritis/RA, also occur in addition to the skin symptoms of scleroderma.

Patients with undifferentiated SSc have Raynaud's syndrome and have the swollen fingers typical for SSc and pulmonary arterial hypertony. Only some of the patients later actually develop diffuse or limited SSc.

The diagnosis of SSc can be provided on the basis of the clinical picture with the typical skin changes. This can be difficult, however, in the early stages of the disease. In addition, the detection of antinuclear antibodies (ANAs) is used. ANAs can be detected in approximately 90% of SSc patients. However, the ANA test is not specific for SSc, since other collagenoses and up to 20% of healthy individuals will test positively. The three most important autoantibodies in the case of SSc are anti-topoisomerase I (Scl-70), anti-centromere (CENP), and anti-RNA polymerase III (anti-RNAP III). These autoantibodies have a high specificity for SSc and are often associated with a subform of SSc. However, these 3 autoantibodies are suitable only to a limited extent for subtyping of SSc, since they do not occur exclusively in one subtype and their frequency can deviate distinctly in different ethnicities. Anti-topomerase antibodies have a high specificity for SSc and are detectable in approximately 30% of patients having diffuse SSc. Anti-centomere antibodies are, by contrast, detectable in approximately 50-60% of patients having limited SSc and in 10% of patients having diffuse SSc. Both autoantibodies are mutually exclusive and are detectable jointly in patients only in very rare cases. Anti-RNAP III antibodies are detectable more frequently in the diffuse form and constitute a risk factor for renal crisis. On the whole, only approximately 70% of SSc patients can be identified diagnostically using the autoantibodies against anti-topoisomerase, anti-centromere and anti-RNAP (Mierau et al. 2011; Mehra et al. 2013).

Antibodies against U1-RNP and PM-Scl antibodies also occur more rarely. These, however, have only a low specificity for SSc: anti-PM-Scl antibodies are often detected in patients having polymyositis/SSc overlap syndrome. Antibodies against U1-RNP are detectable both in the case of SSc and in the case of mixed connective tissue diseases (MCTD) and SLE. In approximately one third of patients, antibodies against typical collagenosis antigens, such as Rho52/SS-A, Ro60/SS-B, and citrullinated peptide (ACPA) and rheumatoid factors are also detected.

In clinical practice, the diagnosis of an early form of SSc and classification thereof into the subgroups constituted by diffuse, limited or overlap syndrome is often difficult, since not all symptoms are yet present or approximately 10-30% of patients carry symptoms of a different collagenosis (connective tissue disease). Since the various subforms have a very different prognosis, there is a substantial need for biomarkers for improved diagnosis of SSc and for a classification into SSc subgroups. There is also a great need for prognostic and predictive biomarkers.

A further problem of the currently used diagnostic methods is that the suitability of the previously tested autoantigens for the diagnosis of organ involvement and complications is disputed, and partly conflicting data has been published.

There is thus also a need for new markers for SSc and also a need to improve the sensitivity and specificity of the previously most frequent diagnostically used autoantigens by the use of new autoantigens or markers.

The object has been achieved in accordance with the invention in that a differential method comprising a multiplicity of steps has been developed, in which serum samples of a large number of healthy individuals and patients with various autoimmune diseases were examined by comparison in respect of their reactivity with a multiplicity of potential antigens and these results were statistically evaluated. The selection of the serum samples and the sequence of the steps surprisingly made it possible to identify highly specific markers for SSc which are also suitable for identifying SSc subgroups and complications and for providing a differential diagnosis in respect of other autoimmune diseases, such as rheumatoid arthritis (RA), in particular early stages of RA ("early RA"), and ankylosing spondylitis or Bekhterev's disease (SPA).

The invention relates to a multi-stage method for identifying specific markers for SSc and also the markers for SSc identified with the aid of the method, and the use and/or specific therapeutic application of these markers for the diagnosis and/or differential diagnosis of systemic sclerosis and/or distinguishing of clinical subgroups of SSc.

One subject of the present invention is therefore a method for identifying markers for systemic sclerosis (SSc), said method comprising the following steps:

a) bringing serum samples of at least 50, preferably 100 SSc patients into contact with more than 5000 antigens coupled to beads, for example Luminex beads, measuring the binding of the individual antigens to proteins in the serum samples of the SSc patients by immunofluorescence assay, and determining the median fluorescence intensity (MFI) for each individual antigen;

b) bringing serum samples of at least 50, preferably 100 patients with lupus erythematodes (SLE) into contact with the same antigens coupled to beads, for example Luminex beads, measuring the binding of the individual antigens to proteins in the serum samples of the SLE patients by means of immunofluorescence assay, and determining from this the median fluorescence intensity (MFI) for each individual antigen;

c) bringing serum samples of at least 50, preferably 537 patients with early rheumatoid arthritis (RA) into contact with the same antigens coupled to beads, for example Luminex beads, measuring the binding of the individual antigens to proteins in the serum samples of the RA patients by means of immunofluorescence assay, and determining from this the median fluorescence intensity (MFI) for each individual antigen;

d) bringing serum samples of at least 50, preferably 82 patients with ankylosing spondylitis (SPA) into contact with the same antigens coupled to beads, for example Luminex beads, measuring the binding of the individual antigens to proteins in the serum samples of the SPA patients by means of immunofluorescence assay, and determining from this the median fluorescence intensity (MFI) for each individual antigen;

e) bringing serum samples of at least 50, preferably 343 healthy individuals into contact with the same antigens coupled to beads, for example Luminex beads, measuring the binding of the individual antigens to proteins in the serum samples of the healthy individuals by means of immunofluorescence assay, and determining from this the median fluorescence intensity (MFI) for each individual antigen;

f) statistically evaluating the MFI data of each individual antigen from a), b), c), d) and e) by means of univariate analysis and thus identifying markers with which SSc patients can be differentiated from patients with SLE, patients with early RA, patients with SPA, and from healthy individuals;

g) and wherein the markers are selected from the sequences SEQ ID No. 1 to 955, homologues of sequences SEQ ID No. 1 to 955 with at least 95% homology, and subsequences of SEQ ID No. 1 to 955 and subsequences of homologues of SEQ ID No. 1 to 955 with at least 95% homology, and sequences coded by SEQ ID No. 1 to 319.

The beads used in the method according to the invention in steps a) to e) are preferably fluorescence-labelled.

The terms systemic sclerosis (SSc), RA or early RA, SLE, and SPA are defined for example in Pschyrembel, Clinical Dictionary, de Gruyter, $261^{st}$ edition (2011).

In a preferred embodiment of the method, the markers are selected after univariate statistical analysis in that they have a threshold value of p less than 0.05 and a reactivity in the SSc group modified 1.5 times with respect to the control group. The control group comprises or consists of patients with SLE and/or patients with early RA and/or patients with SPA and/or healthy individuals. Healthy individuals are individuals in which no SSc, no SSc subform, no early RA, and no SPA has been detected or can be detected.

The invention also relates to a marker for SSc or one or more SSc subforms obtainable by the method according to the invention.

The invention also relates to a marker for SSc or one or more SSc subgroups selected from the sequences SEQ ID No. 1 to 955, homologues of sequences SEQ ID No. 1 to 955 with at least 95% homology, and subsequences of SEQ ID No. 1 to 955 and subsequences of homologues of SEQ ID No. 1 to 955 with at least 95% homology, and sequences coded by SEQ ID No. 1 to 319. The SSc subgroups are, for example, diffuse SSc (dSSc for short), limited SSc (lSSc for short) and/or overlap syndrome SSc (SSc-OS for short).

The invention also relates to a marker for SSc selected from the sequences SEQ ID No. 1, 3-5, 8-33, 320, 322-324, 327-352, 639, 641-643, 646-671, homologues of sequences SEQ ID No. 1, 3-5, 8-33, 320, 322-324, 327-352, 639, 641-643, 646-671 with at least 95% homology, and subsequences of SEQ ID No. 1, 3-5, 8-33, 320, 322-324, 327-352, 639, 641-643, 646-671, and subsequences of homologies of SEQ ID No. 1, 3-5, 8-33, 320, 322-324, 327-352, 639, 641-643, 646-671 with at least 95% homology, and sequences coded by SEQ ID No. 1, 3-5, 8-33.

The invention also relates to a marker for dSSc selected from the sequences SEQ ID No. 6, 7, 34-103, 325, 326, 353-422, 644, 645, 672-741, homologues of sequences SEQ ID No. 6, 7, 34-103, 325, 326, 353-422, 644, 645, 672-741 with at least 95% homology, and subsequences of SEQ ID No. 6, 7, 34-103, 325, 326, 353-422, 644, 645, 672-741, and subsequences of homologues of SEQ ID No. 6, 7, 34-103, 325, 326, 353-422, 644, 645, 672-741 with at least 95% homology, and sequences coded by SEQ ID No. 6, 7, 34-103.

The invention also relates to a marker for lSSc selected from the sequences SEQ ID No. 2, 104-171, 321, 423-490, 640, 742-809, homologues of sequences SEQ ID No. 2, 104-171, 321, 423-490, 640, 742-809 with at least 95% homology, and subsequences of SEQ ID No. 2, 104-171, 321, 423-490, 640, 742-809, and subsequences of homologues of SEQ ID No. 2, 104-171, 321, 423-490, 640, 742-809 with at least 95% homology, and sequences coded by SEQ ID No. 2, 104-171.

The invention also relates to a marker for SSc-OS selected from the sequences SEQ ID No. 173-291, 492-610, 811-929, homologues of sequences SEQ ID No. 173-291, 492-610, 811-929 with at least 95% homology, and subsequences of SEQ ID No. 173-291, 492-610, 811-929, and subsequences of homologues of SEQ ID No. 173-291, 492-610, 811-929 with at least 95% homology, and sequences coded by SEQ ID No. 173-291.

The invention also relates to a panel (arrangement) of markers for SSc or SSc subgroups comprising at least two or three different markers selected independently of one another from the sequences SEQ ID No. 1 to 955, homologues of sequences SEQ ID No. 1 to 955 with at least 95% homology, and subsequences of SEQ ID No. 1 to 955 and subsequences of homologues of SEQ ID No. 1 to 955 with at least 95% homology and coded by the sequences SEQ ID No. 1 to 319. Preferred panels are also presented in the examples.

On account of the high clinical and serological heterogeneity of the SSc disease, it is difficult to diagnose SSc unambiguously using just one biomarker. It is therefore often necessary to combine (where possible) uncorrelated autoantigens to form what are known as panels of markers ("biomarker panels for SSc"). By way of example, within the scope of individualised medicine, corresponding panels of markers for SSc can be composed individually for the relevant SSc subtype (subgroup) for individual patients or patient groups. It is therefore also necessary to have available a multiplicity of potential markers for SSc in order to select suitable subgroups or subtypes of specific markers for SSc for the individual case in question. A corresponding panel can be embodied for example in the form of an arrangement, an array, or also one or more beads. The invention thus relates to an arrangement comprising one or more markers according to the invention, a protein array comprising one or more markers according to the invention, and a bead (pellet or platelet) comprising one or more markers according to the invention.

The invention also relates to diagnostic device or a test kit comprising at least one marker for SSc or SSc subgroups selected from the sequences SEQ ID No. 1 to 955, homologues of sequences SEQ ID No. 1 to 955 with at least 95% homology, and subsequences of SEQ ID No. 1 to 955 and subsequences of homologues of SEQ ID No. 1 to 955 with at least 95% homology and coded by the sequences SEQ ID No. 1 to 319.

The invention also relates to the use of at least one marker selected from the sequences SEQ ID No. 1 to 955, homologues of sequences SEQ ID No. 1 to 955 with at least 95% homology, and subsequences of SEQ ID No. 1 to 955 and subsequences of homologues of SEQ ID No. 1 to 955 with at least 95% homology and coded by the sequences SEQ ID No. 1 to 319 or
at least one panel of markers or a diagnostic device or test kit for identifying subgroups of SSc patients, for diagnosis of SSc, for differential diagnosis of SSc or SSc subgroups, in particular for distinguishing SSc from other autoimmune diseases or rheumatic diseases, for diagnosis of dSSc, lSSc or SSc-OS, for prognosis of SSc, for therapy control in SSc, for active substance selection in SSc, for therapy monitoring in SSc, and for aftercare in SSc.

The invention also relates to the use of at least one marker selected from the sequences SEQ ID No. 1, 3-5, 8-33, 320, 322-324, 327-352, 639, 641-643, 646-671, homologues of sequences SEQ ID No. 1, 3-5, 8-33, 320, 322-324, 327-352, 639, 641-643, 646-671 with at least 95% homology, and subsequences of SEQ ID No. 1, 3-5, 8-33, 320, 322-324, 327-352, 639, 641-643, 646-671, and subsequences of homologues of SEQ ID No. 1, 3-5, 8-33, 320, 322-324, 327-352, 639, 641-643, 646-671 with at least 95% homology, and sequences coded by SEQ ID No. 1, 3-5, 8-33 for diagnosis of SSc.

The invention also relates to the use of at least one marker selected from the sequences SEQ ID No. 6, 7, 34-103, 325, 326, 353-422, 644, 645, 672-741, homologues of sequences SEQ ID No. 6, 7, 34-103, 325, 326, 353-422, 644, 645, 672-741 with at least 95% homology, and subsequences of SEQ ID No. 6, 7, 34-103, 325, 326, 353-422, 644, 645, 672-741, and subsequences of homologues of SEQ ID No. 6, 7, 34-103, 325, 326, 353-422, 644, 645, 672-741 with at least 95% homology, and sequences coded by SEQ ID No. 6, 7, 34-103 for diagnosis of dSSc, for differential diagnosis of dSSc, in particular for distinguishing dSSc from other autoimmune diseases or rheumatic diseases or from lSSc or SSc-OS, for prognosis of dSSc, for therapy control in dSSc, for active substance selection in dSSc, for therapy monitoring in dSSc, and for aftercare in dSSc.

The invention also relates to the use of at least one marker selected from the sequences SEQ ID No. 2, 104-171, 321, 423-490, 640, 742-809, homologues of sequences SEQ ID No. 2, 104-171, 321, 423-490, 640, 742-809 with at least 95% homology, and subsequences of SEQ ID No. 2, 104-171, 321, 423-490, 640, 742-809, and subsequences of homologues of SEQ ID No. 2, 104-171, 321, 423-490, 640, 742-809 with at least 95% homology, and sequences coded by SEQ ID No. 2, 104-171 for diagnosis of lSSc, for differential diagnosis of lSSc, in particular for distinguishing lSSc from other autoimmune diseases or rheumatic diseases or from dSSc or SSc-OS, for prognosis of lSSc, for therapy control in dSSc, for active substance selection in lSSc, for therapy monitoring in lSSc, and for aftercare in lSSc.

The invention also relates to the use of at least one marker selected from the sequences SEQ ID No. 173-291, 492-610, 811-929, homologues of sequences SEQ ID No. 173-291, 492-610, 811-929 with at least 95% homology, and subsequences of SEQ ID No. 173-291, 492-610, 811-929, and subsequences of homologues of SEQ ID No. 173-291, 492-610, 811-929 with at least 95% homology, and sequences coded by SEQ ID No. 173-291 for diagnosis of SSc-OS, for differential diagnosis of SSc-OS from other autoimmune diseases or rheumatic diseases or from dSSc or lSSc, for prognosis of SSc-OS, for therapy control in SSc-OS, for active substance selection in SSc-OS, for therapy monitoring in SSc-OS, and for aftercare in SSc-OS.

The invention also relates to a method for the early detection, diagnosis, differential diagnosis, prognosis, therapy control and/or aftercare of SSc or SSc subgroups, in which
  a. at least one of the markers selected from the sequences SEQ ID No. 1 to 955, the homologues of sequences SEQ ID No. 1 to 955 with at least 95% homology, the subsequences of SEQ ID No. 1 to 955 or the subsequences of homologues of SEQ ID No. 1 to 955 with at least 95% homology, or coded by SEQ ID No. 1-319;
  b. is brought into contact with bodily fluid or a tissue sample from an individual to be tested, and
  c. an interaction of the bodily fluid or of the tissue sample with the one or more markers from a. is detected.

The invention also relates to a composition, preferably a pharmaceutical composition for specific application in the case of SSc or SSc subgroups, comprising at least one of the sequences SEQ ID No. 1 to 955, the homologues of sequences SEQ ID No. 1 to 955 with at least 95% homology, subsequences of SEQ ID No. 1 to 955 or the subsequence of the homologues of SEQ ID No. 1 to 955 with at least 95% homology, or the sequences coded by SEQ ID No. 1-319.

The invention also relates to a target for the therapy of SSC selected from the sequences SEQ ID No. 1 to 955, the homologues of sequences SEQ ID No. 1 to 955 with at least 95% homology, the subsequences of SEQ ID No. 1 to 955 and the subsequences of the homologues of SEQ ID No. 1 to 955 with at least 95% homology, and also the proteins coded by the sequences.

The invention also relates to a method for screening active substances for SSc or SSc subgroups, in which
  a. at least one of the markers selected from the sequences SEQ ID No. 1 to 955, the homologues of sequences SEQ ID No. 1 to 955 with at least 95% homology, the subsequences of SEQ ID No. 1 to 955 or the subsequences of homologues of SEQ ID No. 1 to 955 with at least 95% homology, or the sequences coded by SEQ ID No. 1-319;
  b. is brought into contact with a substance to be tested, and
  c. an interaction of the substance to be tested with the one or more markers from a. is detected.

The large clinical heterogeneity of SSc currently constitutes a big problem both for diagnosis and for active substance development.

The identification of specific antibody signatures in SSc patient subgroups therefore constitutes an important step for the improved definition of patient groups in clinical studies. By way of example, specific autoantibodies for dSSc, lSSc or SSc-OS could be used to recruit this subgroup for drug studies.

The invention also relates to the use of one or more markers according to the invention for SSc or SSc subgroups, of an arrangement according to the invention (panel of markers for SSc), of a protein array according to the invention, of a bead according to the invention, of a diagnostic device according to the invention, or of a test kit according to the invention for the individually tailored diagnosis and/or therapy in individual patients, patient groups, cohorts, population groups, variants of SSc, and stages of SSc.

The invention also relates to the use of one or more markers according to the invention for SSc or SSc subgroups, of an arrangement according to the invention (panel of markers for SSc), of a protein array according to the invention, of a bead according to the invention, of a diagnostic device according to the invention, or of a test kit according to the invention for detecting and/or determining the amount of one or more autoantibodies associated with SSc or SSc subgroups, for example in bodily fluids such as serum, tissue or tissue samples of the patient.

The invention also relates to the use of one or more markers according to the invention, of an arrangement according to the invention, of a protein array according to the invention, of a bead according to the invention, of a diagnostic device according to the invention, or of a test kit according to the invention for the analysis of autoantibody profiles of patients, in particular for the qualitative and/or quantitative analysis of autoantibodies and/or for the monitoring of changes of autoantibody profiles associated with SSc or SSc subgroups, for example in bodily fluids such as serum, tissue or tissue samples of the patient.

A particular embodiment of the invention relates to methods for the early identification and diagnosis of SSc or SSc subgroups, in which the detection of an interaction of the bodily fluid or the tissue sample with the one or more markers indicates an SSc- or SSc-subgroup-associated autoantibody profile of the patient or of a cohort or of a population group or of a certain course of disease (prognosis) or of a certain response to a therapy/drug.

The invention therefore includes the use of at least one marker for SSc selected from the sequences SEQ ID No. 1 to 955, the homologues of sequences SEQ ID No. 1 to 955 with at least 95% homology, the subsequences of SEQ ID No. 1 to 955 or the subsequences of homologues of SEQ ID No. 1 to 955 with at least 95% homology, and the proteins coded by the sequences for the analysis of autoantibody profiles of patients, in particular for the quantitative analysis and/or for the monitoring of changes of autoantibody profiles of SSc patients.

An interaction of the bodily fluid or the tissue sample with the one or more SSc markers can be detected for example by a probe, in particular by an antibody.

In a preferred embodiment at least 2, for example 3, 4, 5, 6, 7, 8, 9, 10, preferably 15 to 20 markers for SSc or SSc subgroups or 30 to 50 or 100 or more markers are used together or in combination (what are known as "panels"), either simultaneously or in succession, wherein the markers for SSc are selected independently of one another from the sequences SEQ ID No. 1 to 955, the homologues of sequences SEQ ID No. 1 to 955 with at least 95% homology, the subsequences of SEQ ID No. 1 to 955 or the subsequences of homologues of SEQ ID No. 1 to 955 with at least 95% homology, and the proteins coded by the sequences. This embodiment is implemented preferably in the form of a panel according to the invention.

A particular embodiment of the invention relates to a method according to the invention, wherein the stratification or therapy control includes decisions relating to the treatment and therapy of the patient, in particular hospitalisation of the patient, use, efficacy and/or dosage of one or more drugs, a therapeutic measure, or the monitoring of the course of the disease and course of therapy, aetiology, or classification of a disease inclusive of prognosis. The invention also relates to a method for stratification, in particular for risk stratification and/or therapy control of a patient with SSc.

The stratification of the patient with SSc into new or established SSc subgroups as well as the expedient selection of patient groups for the clinical development of new therapeutic agents is also included. The term therapy control likewise includes the division of patients into responders and non-responders with regard to a therapy or course thereof.

The invention in particular also relates to the detection and determination of the amount of at least two different autoantibodies in a patient by means of the SSc markers according to the invention, wherein at least two different SSc markers are preferably used. The invention also relates to a use according to the invention of one or more SSc markers, wherein at least 2, for example 3 to 5 or 10, preferably 30 to 50, or 50 to 100 or more SSc markers or the relevant autoantibodies on or from a patient to be tested are determined.

The invention comprises the SSc markers on a solid substrate, for example a filter, a membrane, a small platelet or ball, for example a magnetic or fluorophore-labelled ball, a silicon wafer, a bead, a chip, a mass spectrometry target, or a matrix, or the like. Different materials are suitable as substrates and are known to a person skilled in the art, for example glass, metal, plastic, filter, PVDF, nitrocellulose, or nylon (for example Immobilon P Millipore, Protran Whatman, Hybond N+ Amersham).

The substrate for example can correspond to a grid with the dimensions of a microtitre plate (8-12 well strips, 96 wells, 384 wells or more), of a silicon wafer, of a chip, of a mass spectrometry target, or of a matrix.

In one embodiment of the invention markers for SSc are present in the form of clone sequences or clone(s).

The markers according to the invention can be combined, supplemented or extended with known biomarkers for SSc or biomarkers for other diseases. With a combination of this type, a proportion of markers for SSc according to the invention of preferably at least 50%, preferably 60%, and particularly preferably 70% or more is comprised.

In a preferred embodiment the use of the SSc markers is implemented outside the human or animal body, for example the diagnosis is performed ex vivo/in vitro.

In the sense of this invention, the term "diagnosis" means the positive determination of SSc with the aid of the markers according to the invention and the assignment of the patients or symptoms thereof to the disease SSc. The term "diagnosis" includes the medical diagnosis and tests in this respect, in particular in vitro diagnosis and laboratory diagnosis, and also proteomics and nucleic acid blots. Further tests may be necessary for assurance and in order to rule out other diseases. The term "diagnosis" therefore includes in particular the differential diagnosis of SSc by means of the markers according to the invention.

In the sense of this invention, "stratification or therapy control" means that, for example, the methods according to the invention allow decisions for the treatment and therapy of the patient, whether it is the hospitalisation of the patient, the use, efficacy and/or dosage of one or more drugs, a therapeutic measure or the monitoring of the course of a disease and the course of therapy or aetiology or classification of a disease, for example into a new or existing sub-type, or the differentiation of diseases and patients thereof. In a further embodiment of the invention, the term "stratification" in particular includes the risk stratification with the prognosis of an "outcome" of a negative health event.

"Prognosis" means the prediction of the course of a disease.

In accordance with the invention, "therapy control" means, for example, the prediction and monitoring of the response to a drug or a therapy as well as aftercare.

Within the scope of this invention, the term "patient" is understood to mean any test subject, any individual (human or mammal), with the provision that the test subject or individual is tested for SSc.

The term "marker for SSc" in the sense of this invention means that the nucleic acid, for example DNA, in particular cDNA or RNA or the coded amino acid sequence or the polypeptide or protein are significant (specific) for SSc and/or the autoantibody profiles associated with SSc. Markers according to the invention are nucleic acid sequences and/or amino acid sequences according to the definition in the appended sequence protocol (SEQ ID No. 1 to SEQ ID No. 955), homologues and subsequences thereof, wherein modified nucleic acid and amino acid sequences are also included. Here, marker for SSc means, for example, that the cDNA or RNA or the polypeptide or protein obtainable therefrom interacts with substances from the bodily fluid or tissue sample from a patient with SSc (for example antigen (epitope)/antibody (paratope) interaction). In a particularly preferred embodiment of the invention the marker for SSc is an (auto)antigen or part of an antigen or codes for an antigen or for part of an antigen.

The substances from the bodily fluid or tissue sample occur either only in an amplified manner or at least in an amplified manner in the case of SSc or are expressed, whereas these substances are not present in patients without SSc or healthy individuals, or at least are present to a lesser extent (smaller amount, lower concentration). Markers for SSc can also be characterised in that they interact with substances from the bodily fluid or tissue sample from patients with SSc, because these substances no longer occur or are no longer expressed or occur or are expressed at least in a much lower amount/concentration in the case of SSc, whereas these substances are present or are at least present to a much higher extent in patients without SSc. Markers for SSc can also be present in healthy test subjects, however the amount (concentration) thereof changes for example with the development, establishment and therapy of SSc. One or more markers can in this way map a profile of substances from bodily fluid and tissue sample, for example an SSc-associated autoantibody profile of the patient in question. Markers according to the invention are biomarkers for SSc.

Autoantibody profiles comprise the amount of one or more autoantibodies of which the occurrence/expression accompanies the development and/or establishment of SSc. Autoantibody profiles therefore include on the one hand the composition, i.e. one or more autoantibodies is/are expressed only in the case of SSc for example, and also the amount/concentration of individual autoantibodies, i.e. the amount/concentration of individual autoantibodies changes with the development and establishment of SSc. These changes can be detected with the aid of the marker (sequences) according to the invention.

In a particularly preferred embodiment the SSc marker identifies/binds to autoantibodies which are present (intensified) or are present to a lower extent (or no longer) during the course of the development, establishment and therapy of SSc. Autoantibodies are formed by the body against endogenous antigens which are formed for example in the case of SSc. Autoantibodies are formed by the body against different substances and pathogens. Within the scope of the present invention, the autoantibodies which are formed with the occurrence and during the course of the development of SSc and/or of which the expression is up-regulated or down-regulated are detected in particular. These autoantibodies can be detected with the aid of the methods and markers according to the invention, and the detection and monitoring (for example of the amount) thereof can be used for the early identification, diagnosis and/or therapy monitoring/therapy control and the prognosis and prediction of the risk of the re-occurrence of SSc within the scope of the aftercare.

The autoantibody profiles can be sufficiently characterised with use of just a single SSc marker. In other cases, two or more SSc markers are necessary in order to map an autoantibody profile which is specific for SSc.

In one embodiment of the invention autoantibodies which derive from another individual and which for example originate from a commercial cDNA bank can be detected using SSc markers.

In another embodiment of the invention these autoantibodies can be detected using SSc markers which derive from the same individual and which for example originate from a cDNA bank produced individually for the patient or a group of patients for example within the scope of individualised medicine. By way of example, homologues of the specified SSc markers with the sequences SEQ ID. No. 1 to 955 or subsequences thereof can be used.

Autoantibodies can be formed by the patient already many years prior to the occurrence of the first symptoms of disease. An early identification, diagnosis and also prognosis and preventative treatment or lifestyle change and other possibilities for prevention are therefore possible even years prior to the visible outbreak of the disease. The devices, means and methods according to the invention enable a very early intervention compared with known methods, which significantly improves the prevention, treatment possibilities and effects of SSc.

Since the SSc-associated autoantibody profiles change during the establishment and treatment/therapy of SSc, the invention also enables the detection and monitoring of SSc at any stage of the development and treatment and also monitoring within the scope of SSc aftercare. The means according to the invention, for example a corresponding diagnostic device or a test kit, also allow simple handling at home by the patient and an economical routine precautionary measure for early identification.

In particular due to the use of antigens as specific markers for SSc which derive from sequences already known, for example from commercial cDNA banks, test subjects can be tested and any present SSc-associated autoantibodies can be detected in these test subjects, even if the corresponding autoantigens are not (yet) known in these test subjects.

Different patients can have different SSc-associated autoantibody profiles, for example different cohorts or population groups can differ from one another. Here, any patient can form one or more different SSc-associated autoantibodies during the course of the development of SSc and the progression of the SSc disease, that is to say even different autoantibody profiles. In addition, the composition and/or the amount of formed autoantibodies can change during the course of the SSc development and progression of the disease, such that a quantitative evaluation is necessary. The therapy/treatment of SSc leads to changes in the composition and/or the amount of SSc-associated autoantibodies. The large selection of SSc markers according to the invention which are provided with this invention enables the individual compilation of SSc markers in an arrangement, i.e. a panel, for individual patients, groups of patients, certain cohorts, population groups and the like. In one individual case, the use of one SSc marker may therefore be sufficient, whereas in other cases at least two or more SSc markers must be used together or in combination in order to create a conclusive autoantibody profile.

Compared with other biomarkers, the detection of SSc-associated autoantibodies for example in the serum or plasma of patients has the advantage of high stability and storage capability and good detectability. The presence of autoantibodies also is not subject to a circadian rhythm, and therefore the sampling is independent of the time of day, food intake, and the like.

In addition, the SSc-associated autoantibodies can be detected with the aid of the corresponding antigens/autoantigens in known assays, such as ELISA or Western Blot, and the results can be checked in this way.

In the sense of the invention, an interaction between the SSc marker and the serum in question, for example an autoantibody of the patient, is detected. Such an interaction is, for example, a bond, in particular a binding substance on at least one SSc-specific marker, or, in the case that the SSc-specific marker is a nucleic acid, for example a cDNA, the hybridisation with a suitable substance under selected conditions, in particular stringent conditions (for example as defined conventionally in J. Sambrook, E. F. Fritsch, T. Maniatis (1989), Molecular cloning: A laboratory manual, 2nd Edition, Cold Spring Habor Laboratory Press, Cold Spring Habor, USA or Ausubel, "Current Protocols in Molecular Biology", Green Publishing Associates and Wiley Interscience, N.Y. (1989)). One example of stringent hybridisation conditions is: hybridisation in 4×SSC at 65° C. (alternatively in 50% formamide and 4×SSC at 42° C.), followed by a number of washing steps in 0.1×SSC at 65° C. for a total of approximately one hour. An example of less stringent hybridisation conditions is hybridisation in 4×SSC at 37° C., followed by a number of washing steps in 1×SSC at room temperature. The interaction between the bodily fluid or tissue sample from a patient and the markers for SSc is preferably a protein-protein interaction.

In accordance with the invention, such substances, for example antigens, autoantigens and SSc-associated autoantibodies, are part of a bodily fluid, in particular blood, whole blood, blood plasma, blood serum, patient serum, urine, cerebrospinal fluid, synovial fluid or a tissue sample from the patient. The invention in particular relates to the use of these bodily fluids and tissue samples for early detection, diagnosis, prognosis, therapy control and aftercare.

The SSc-specific markers, in a further embodiment of the invention, have a recognition signal that is addressed to the substance to be bound (for example antibody, nucleic acid). In accordance with the invention, the recognition signal for a protein is preferably an epitope and/or paratope and/or hapten, and for a cDNA is preferably a hybridisation or binding region.

Homologues of the markers according to the invention SEQ ID No. 1 to 955, as presented in the claims for example, are also included. Within the sense of the invention, homologues are those with homology of the amino or nucleic acid sequence and those in which the corresponding sequence is modified, for example the protein variants, which indeed have the same amino acid sequence, but differ with regard to the modification, in particular the post-translational modification.

In accordance with the invention, modifications of the nucleic acid sequence and of the amino acid sequence, for example citrullination, acetylation, phosphorylation, glycosylation, ethylation, or polyA strand extensions and further modifications known as appropriate to a person skilled in the art are included.

Homologues also include sequence homologues of the markers and subsequences thereof. Sequence homologues are, for example, nucleic acid sequences and/or protein sequences that have an identity with the SSc markers of the sequences SEQ ID No. 1 to 955 of at least 70% or 80%, preferably 90% or 95%, particularly preferably 96% or 97% or more, for example 98% or 99%. In a particularly preferred embodiment of the invention, for the case in which the SSc markers are antigens, the homology in the sequence range in which the antigen-antibody or antigen-autoantibody interaction takes place, is at least 95%, preferably at least 97%, particularly preferably at least 99%. For example, mutations such as base exchange mutations, frameshift mutations, base insertion mutations, base loss mutations, point mutations and insertion mutations, are included in accordance with the invention.

The invention also relates to subsequences of the SSc markers with the sequence SEQ ID No. 1 to 955. Subsequences also include nucleic acid or amino acid sequences that are shortened compared with the entire nucleic acid or the entire protein/peptide. Here, the deletion may occur at the end or the ends and/or within the sequence. For example, subsequences and/or fragments that have 50 to 100 nucleotides or 70-120 nucleotides of the sequence SEQ ID No. 1 to 955 are included. Homologues of subsequences are also included in accordance with the invention. In a particular embodiment, the SSc markers are shortened compared with the sequences SEQ ID No. 1 to 955 to such an extent that they still consist only of the binding point(s) for the SSc-associated autoantibody in question. In accordance with the invention, SSc markers are also included that differ from the sequences SEQ ID No. 1 to 955 in that they contain one or more insertions, wherein the insertions for example are 1 to 100 or more nucleotide/amino acids long, preferably 5 to 50, particularly preferably 10 to 20 nucleotides/amino acids long and the sequences are otherwise identical however or homologous to sequences SEQ ID No. 1 to 955. Subsequences that have at least 90%, preferably at least 95%, particularly preferably 97% or 98%, of the length of the SSc markers according to the invention with sequences SEQ ID No. 1 to 955 are particularly preferred.

In a further embodiment, the respective SSc marker can be represented in different quantities in one or more regions in the arrangement or on the substrate or in a panel. This allows a variation of the sensitivity. The regions may each have a totality of SSc markers, that is to say a sufficient number of different SSc markers, in particular 2, 3, 4, 5, 6, 7, 8, 9 or 10 or more different SSc markers. By way of example, 20 to 50 (numerically) or more, preferably more than 100, particularly preferably 150 or more, for example 25,000 or 5,000 or 10,000 different or same SSc marker sequences and where applicable further nucleic acids and/or proteins, in particular other biomarkers can be represented on the substrate or in the panel.

Within the scope of this invention, "arrangement" is synonymous with "array" and "panel". If this "array" is used to identify substances on SSc markers, this is to be understood preferably to be an "assay" or a bead or a diagnostic device or a screening assay. In a preferred embodiment, the arrangement is designed such that the markers represented on the arrangement are present in the form of a grid on a substrate. Furthermore, those arrangements are preferred that permit a high-density arrangement of SSc markers. The markers are preferably spotted. Such high-density spotted arrangements are disclosed for example in WO 99/57311 and WO 99/57312 and can be used advantageously in a robot-supported automated high-throughput method.

Within the scope of this invention, however, the term "assay" or diagnostic device likewise comprises those embodiments such as ELISA, bead-based assay, line assay, Western Blot, and immunochromatographic methods (for example what are known as lateral flow immunoassays) or similar immunological single or multiplex detection methods.

A "protein array" in the sense of this invention is the systematic arrangement of SSc markers on a solid substrate, wherein the substrate can have any shape and/or size, and wherein the substrate is preferably a solid substrate.

The SSc markers of the arrangement are fixed on the substrate, preferably spotted or immobilised, printed on or the like, in particular in a reproducible manner. One or more SSc markers can be present multiple times in the totality of all SSc markers and may be present in different quantities based on a spot. Furthermore, the SSc markers can be standardised on the substrate (for example by means of serial dilution series of, for example, human globulins as internal calibrators for data normalisation and quantitative evaluation). A standard (for example a gold standard) can also be applied to the substrate where necessary.

In a further embodiment, the SSc markers are present as clones. Such clones can be obtained for example by means of a cDNA expression library according to the invention. In a preferred embodiment, such expression libraries are obtained using expression vectors from a cDNA expression library comprising the cDNAs of the SSc-specific marker sequences. These expression vectors preferably contain inducible promoters. The induction of the expression can be carried out for example by means of an inducer, such as IPTG. Suitable expression vectors are described in Terpe et al. (Terpe T Appl Microbiol Biotechnol. 2003 January; 60(5):523-33).

Expression libraries are known to a person skilled in the art; they can be produced in accordance with standard works, such as Sambrook et al, "Molecular Cloning, A laboratory handbook, 2nd edition (1989), CSH press, Cold Spring Harbor, N.Y. Expression libraries that are tissue-specific (for example human tissue, in particular human organs) are furthermore preferable. Further, expression libraries that can be obtained by means of exon trapping are also included in accordance with the invention.

Protein arrays or corresponding expression libraries that do not exhibit any redundancy (what is known as a Uniclone® library) and that can be produced for example in accordance with the teaching of WO 99/57311 and WO 99/57312 are furthermore preferred. These preferred Uniclone® libraries have a high proportion of non-defective fully expressed proteins of a cDNA expression library.

Within the scope of this invention, the clones can also be, but are not limited to, transformed bacteria, recombinant phages or transformed cells of mammals, insects, fungi, yeasts or plants.

In addition, the SSc markers can be present in the respective form in the form of a fusion protein, which for example contains at least one affinity epitope or "tag", wherein the tag is selected for example from c-myc, his tag, arg tag, FLAG, alkaline phosphatase, V5 tag, T7 tag or strep tag, HAT tag, NusA, S tag, SBP tag, thioredoxin, DsbA, or the fusion protein has one or more additional domains for example, such as a cellulose-binding domain, green fluorescent protein, maltose-binding protein, calmodulin-binding protein, glutathione S-transferase or lacZ.

In a further embodiment the invention relates to an assay, for example a multiplex assay, a bead-based assay, or protein array for identifying and characterising a substance, for example a hit, a lead substance, or an active substance for SSc. Here, a substance to be tested is used. This can be any native or non-native biomolecule, a (synthetic) chemical molecule, a natural substance, a mixture or a substance library. Once the substance to be tested has contacted an SSc marker, the binding success is evaluated, for example with use of commercially available image-analysis software (GenePix Pro (Axon Laboratories), Aida (Raytest), ScanArray (Packard Bioscience).

Binding according to the invention, binding success, interactions, for example protein-protein interactions (for example protein to SSc marker, such as antigen/antibody) or corresponding "means for detecting the binding success" can be visualised for example by means of fluorescence labelling, biotinylation, radio-isotope labelling or colloid gold or latex particle labelling in the conventional manner. Bound antibodies are detected with the aid of secondary antibodies, which are labelled using commercially available reporter molecules (for example Cy, Alexa, Dyomics, FITC or similar fluorescent dyes, colloidal gold or latex particles), or with reporter enzymes, such as alkaline phosphatase, horseradish peroxidase, etc. and the corresponding colorimetric, fluorescent or chemoluminescent substrates. A read-out is performed for example by means of a microarray laser scanner, a CCD camera or visually.

In a further embodiment, the invention relates to a drug or an active substance or prodrug for SSc, developed and obtainable by the use of an SSc marker according to the invention.

The invention also relates to the use of an SSc marker selected from sequences SEQ ID No. 1 to 955 and subsequences of SEQ ID No. 1 to 955 with at least 90%, preferably at least 95% of the length of SEQ ID No. 1 to 955 and homologues of SEQ ID No. 1 to 955 and subsequences thereof with an identity of at least 95%, preferably at least 98% or more, to the corresponding sequences and proteins/peptides coded by the sequences SEQ ID No. 1 to 638, coded by the subsequences thereof and homologues as affinity material for carrying out an apheresis or blood washing for patients with SSc, i.e. apheresis of SSc autoantibodies. The invention thus relates to the use of the markers according to the invention, preferably in the form of an arrangement, as affinity material for carrying out an apheresis or a blood washing in the broader sense, wherein substances from bodily fluids from a patient with SSc, such as blood or plasma, bind to the markers according to the invention and consequently can be removed selectively from the bodily fluid. The application in blood washing is a special case of use of the SSc markers as a target.

The following examples and drawings explain the invention, but do not limit the invention to the examples. In the following drawings, systemic sclerosis is denoted by PPS (progressive systemic sclerosis).

Figure 3:
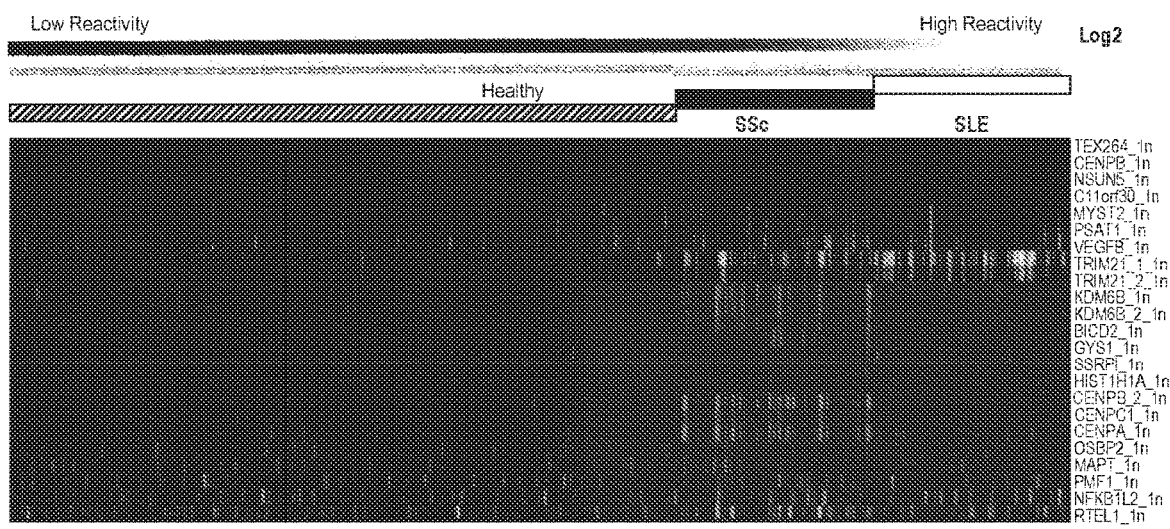

FIG. 3: shows autoantibody reactivities in SSc patient sera compared to healthy controls and SSC patients.

Figure 4:
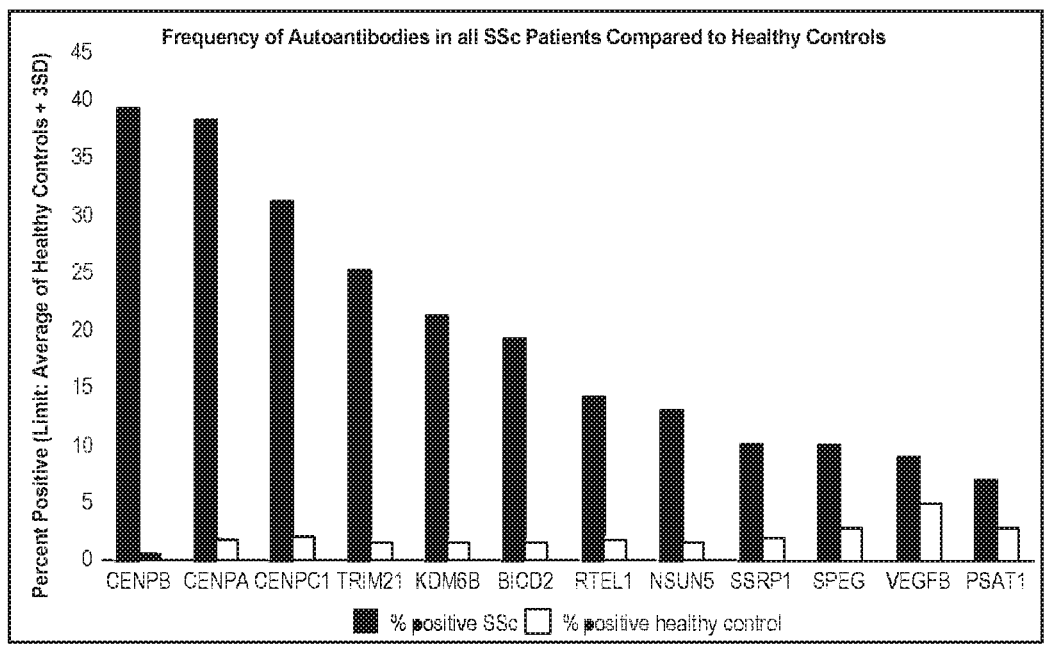

FIG. 4: shows the frequency of the autoantibody reactivities of selected antigens in SSc patients and healthy test subjects. A threshold value of 3 SD deviations above the mean value of the healthy test subject was applied.

Figure 5:
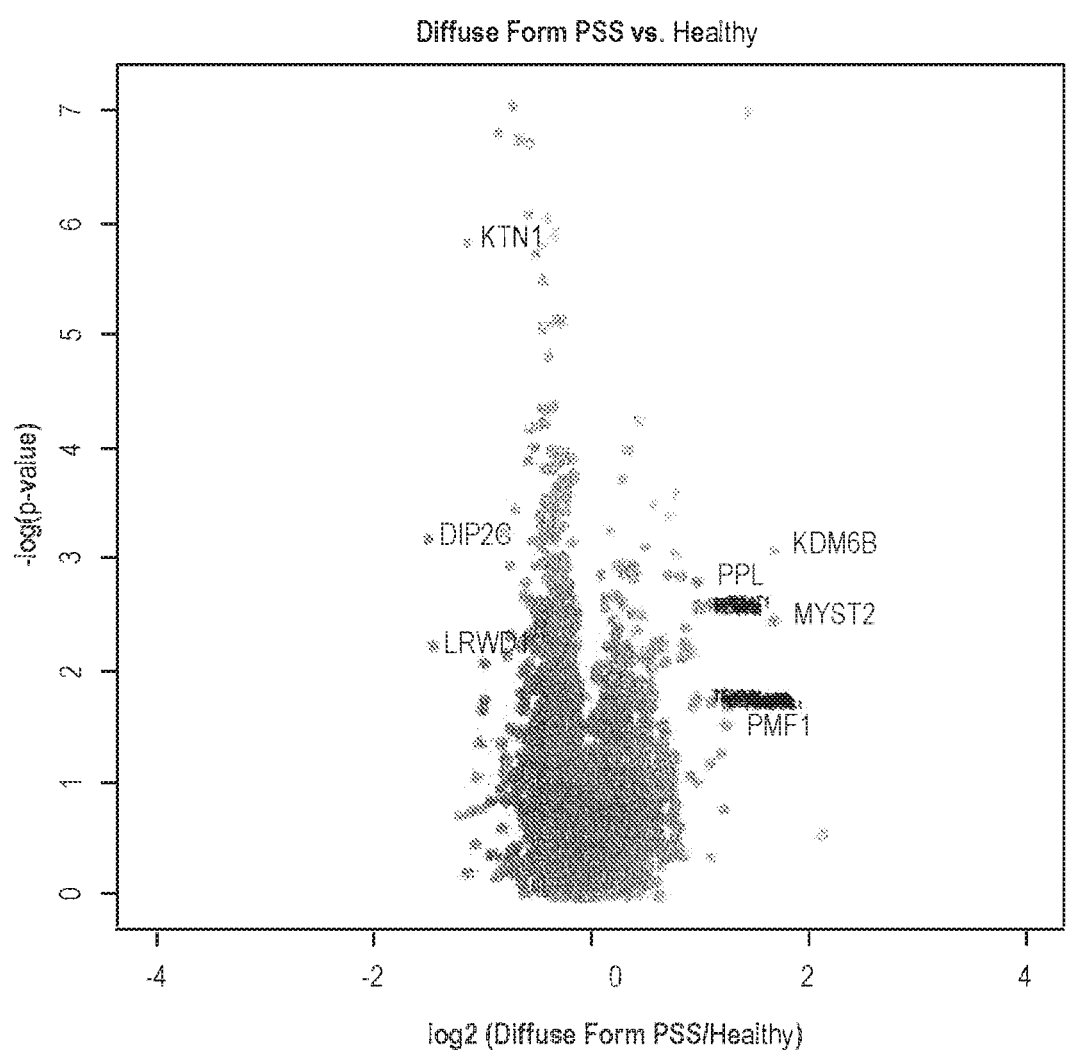

FIG. 5: shows a volcano plot of the autoantibody reactivities of SSc patients with diffuse sub-form compared to healthy controls.

Figure 6:
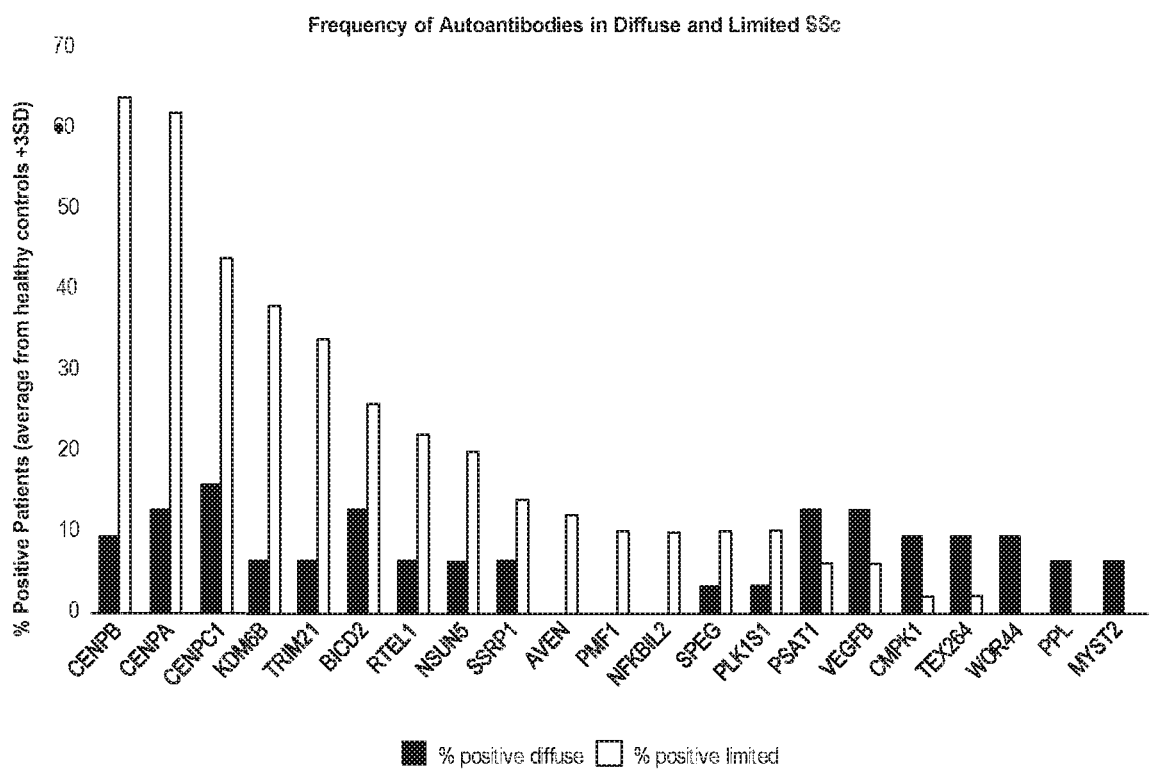

FIG. 6: shows the frequency of the autoantibody reactivities of selected antigens in the limited and diffuse SSc subform. A threshold value of 3 standard deviations above the mean value of the healthy test subject was applied.

Figure 7:
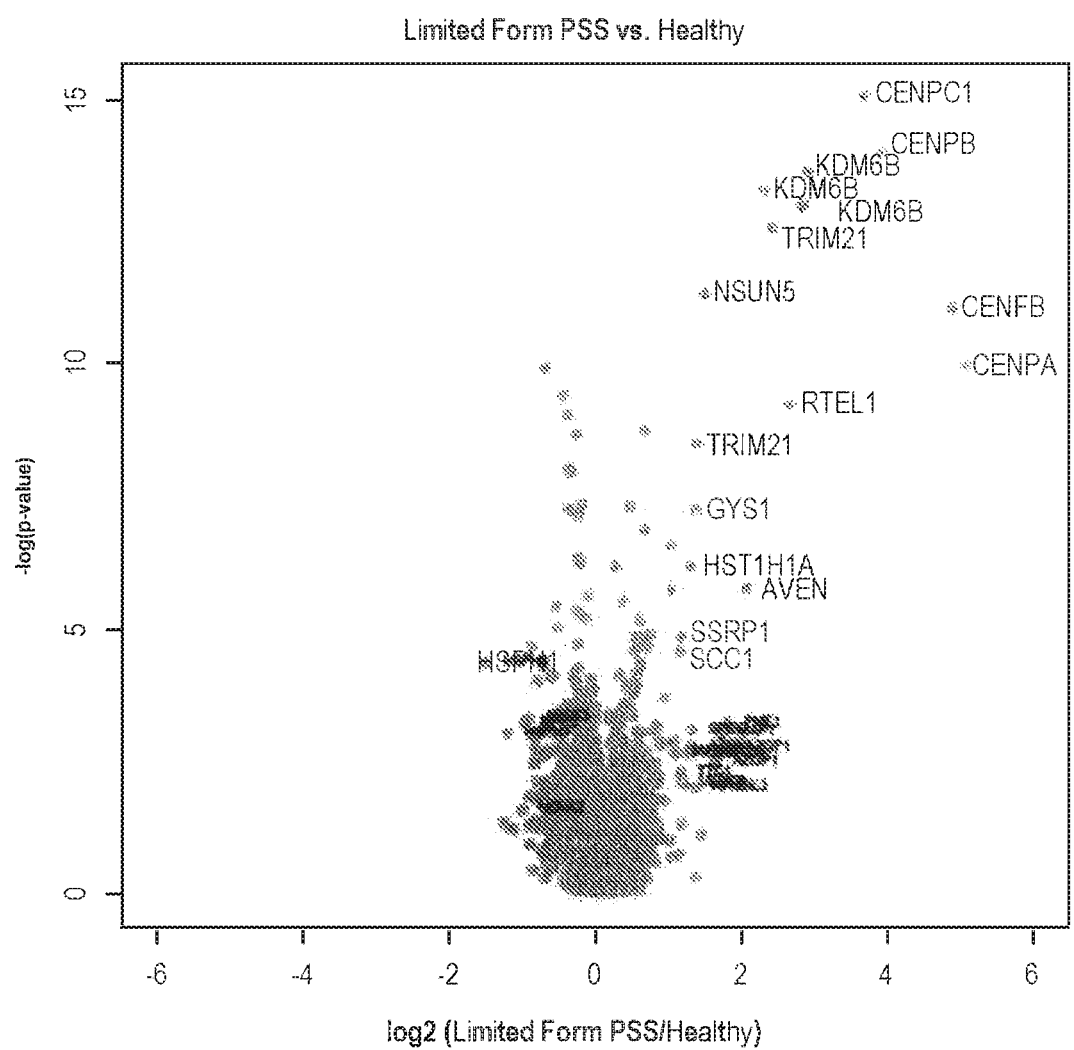

FIG. 7: shows a volcano plot of the autoantibody reactivities of SSc patients with limited subform compared to healthy controls.

Figure 8:
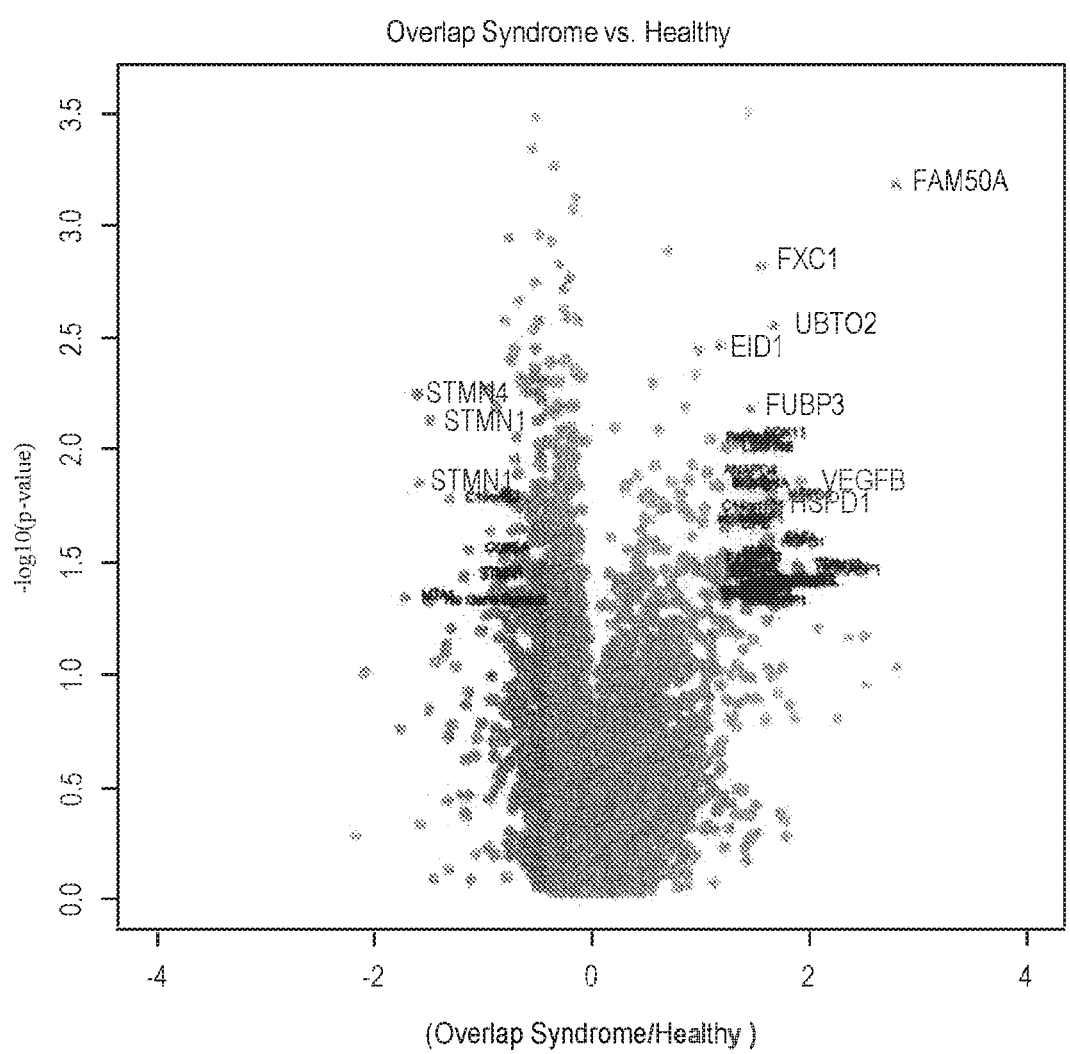
Figure 9:
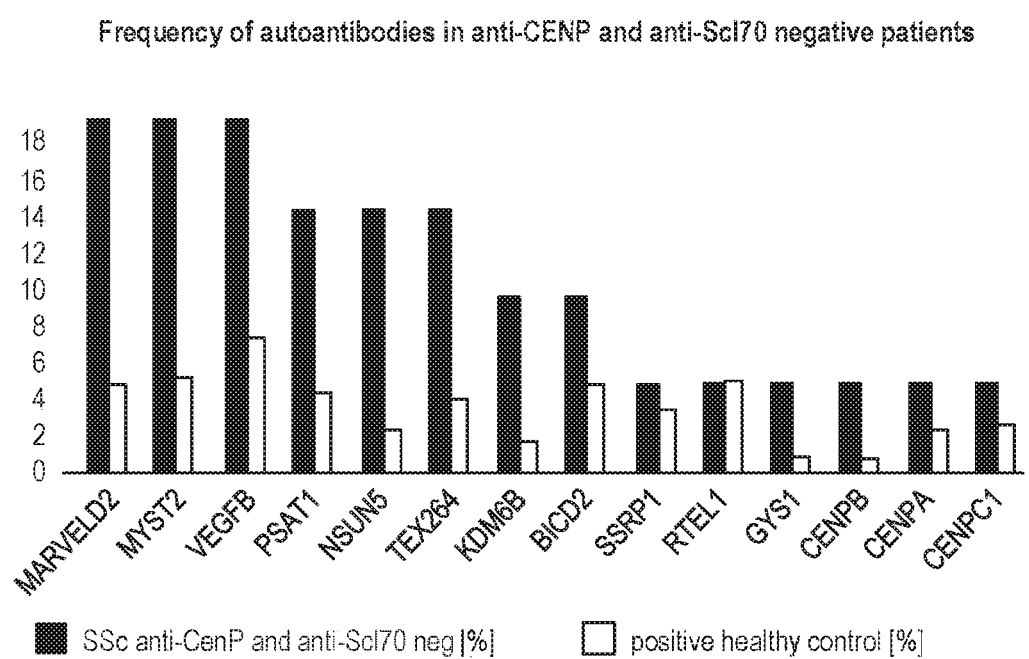

FIG. 8: shows a volcano plot of the autoantibody reactivities of SSc patients with overlap syndrome compared to healthy controls FIG. 9: shows the frequency of the autoantibodies in anti-CENP- and anti-Sc170-negative patients.

Figure 10:
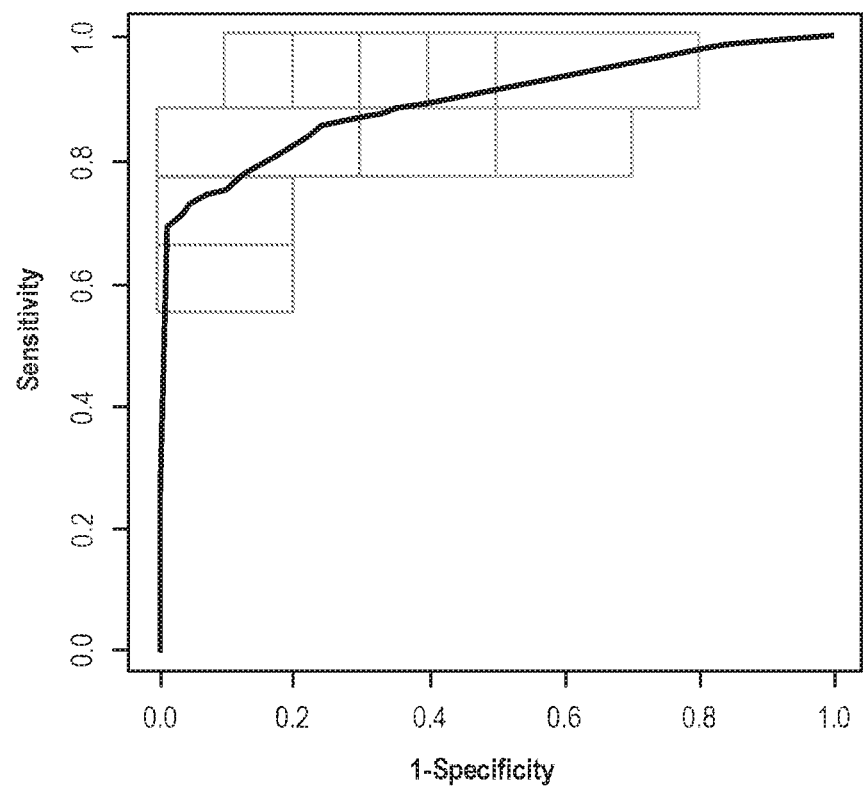
Figure 10:
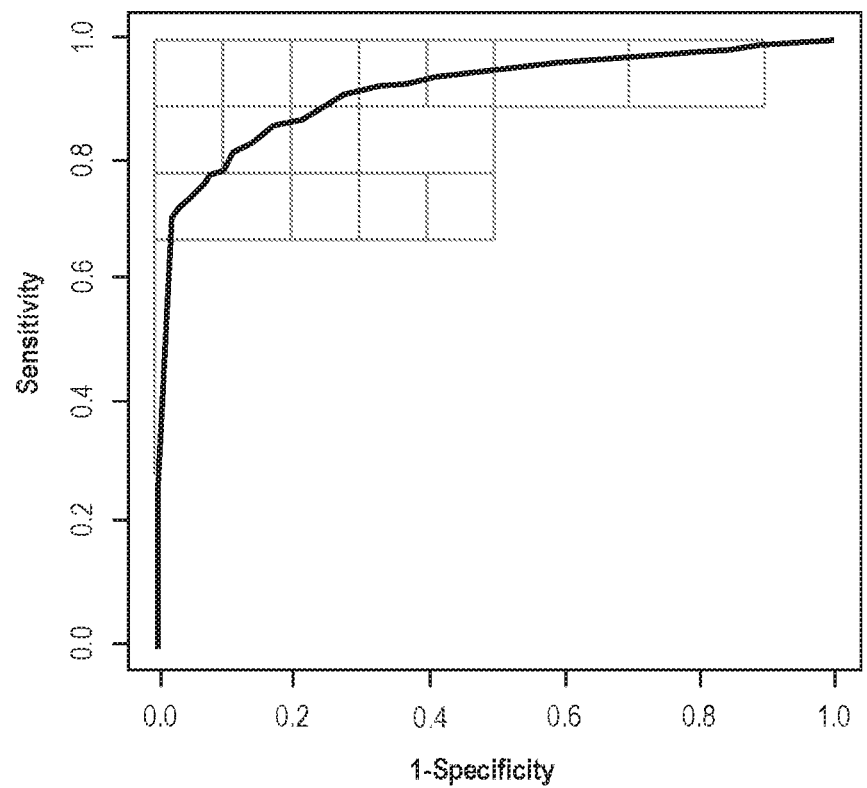

FIG. 10: shows Receiver Operating Characteristic curves (ROCs) for the diagnosis of SSc compared to healthy test subjects; A) ROC curve panel I, B) ROC curve panel II.

Figure 11:
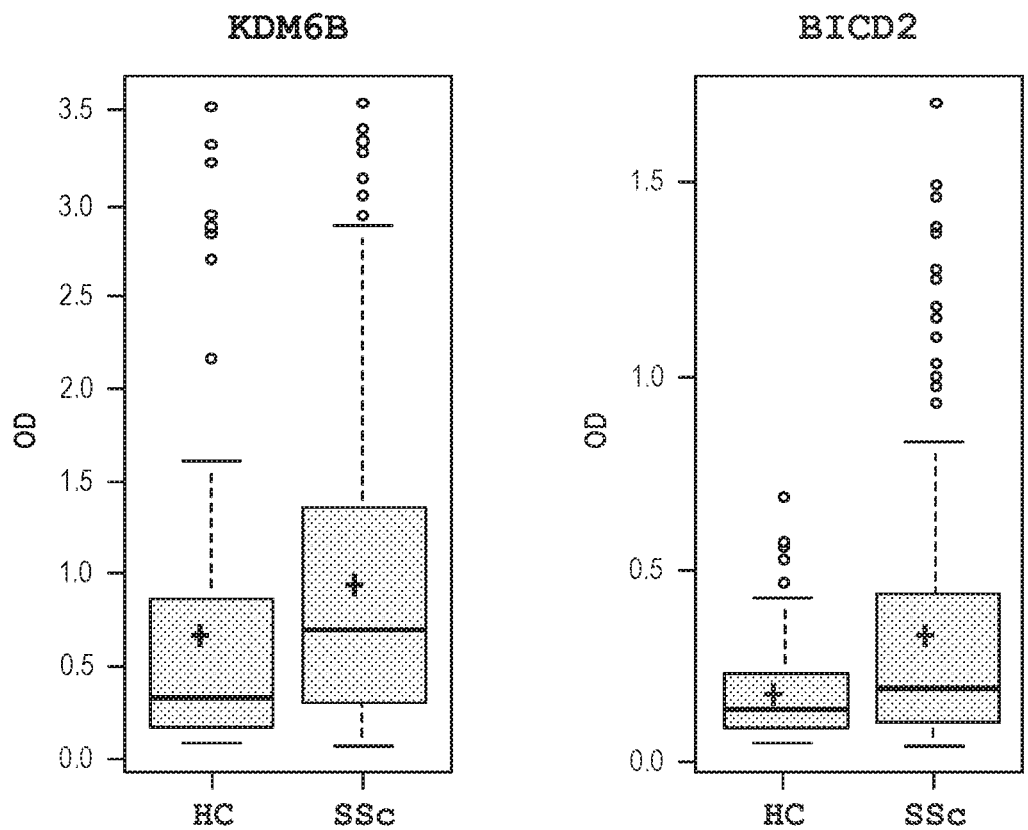
Figure 11:
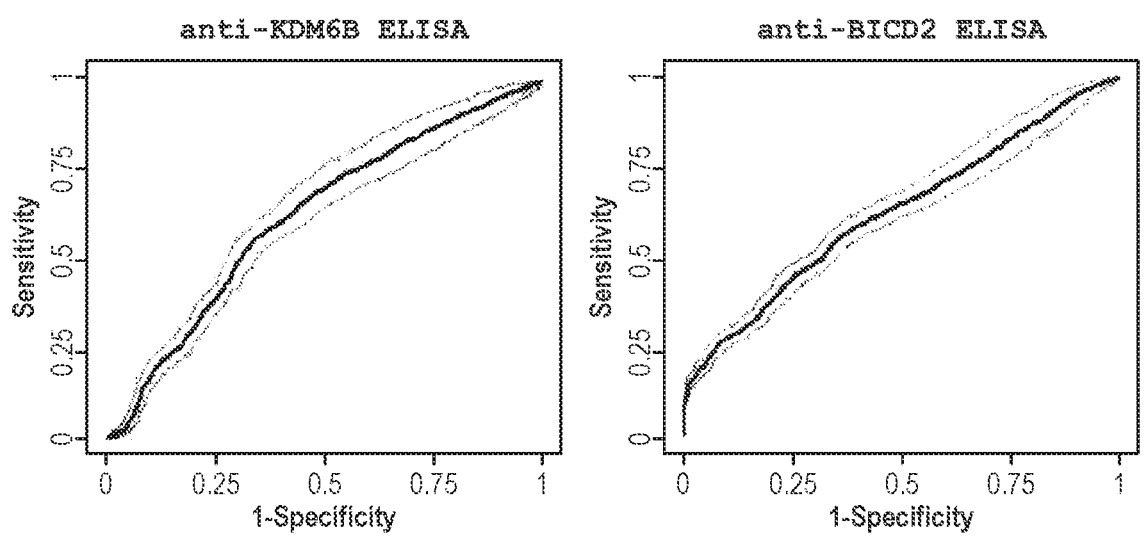

FIG. 11: shows a boxplot based on the anti-KDM6B and anti-BICD2 ELISA measurements for the diagnosis of SSc compared to healthy controls.

FIG. 12: shows Receiver Operating Characteristic curves (ROCs) for the ELISA determination of anti-KDM6B and anti-BICD2 antibodies:
  a) anti-KDM6B ELISA: SSc compared to healthy controls
  b) Anti-BICD2 ELISA: SSc compared to healthy controls

EXAMPLES

Example 1: Selection of the SSc Patient and Control Samples

Patients and Test Subjects

Selection of the patient groups to be tested: Blood samples were analysed from 100 SSc patients, 100 patients with SLS, 537 patients with early rheumatoid arthritis ("RA"; period of disease less than 6 months) and 82 patients with ankylosing spondylitis (SPA) or Bekhterev's disease. 343 blood samples from the Bavarian Red Cross (BRC) were used as control group. An informed consent of the Ethics Commission of the clinical partners and of the biobank of the BRC was received from all test subjects.

TABLE 1

Patient samples and clinical data

|  | SLE | SSc Subgroup lSSc | SSc Subgroup dSSc | SSc Subgroup SSc-OV | SSc no specification of the subgroup | early RA (<6 months) | SPA | Healthy |
| --- | --- | --- | --- | --- | --- | --- | --- | --- |
| Number of patients or samples | 100 | 50 | 32 | 9 | 9 | 537 | 82 | 343 |
| Average age (years) | 39.8 +/− 11.9 | 61.53 +/− 16.97 | 53.88 +/− 14.75 | 51.78 +/− 9.18 | 47.56 +/− 16.97 | 56.8 +/− 14.3 | 43.7 +/− 10.1 | 47.7 +/− 11.7 |
| Number of female patients or samples | 83 | 50 | 32 | 8 | 9 | 62.2 | 15.9 | 58.3 |
| ANA-positive | 100 | 47 | 32 | 9 | 7 | NA | NA | NA |
| Anti-CENP | NA | 30 | 4 | 2 | 2 | NA | NA | NA |
| Anti-Scl70 | NA | 9 | 20 | 1 | 2 | NA | NA | NA |

Example 2: Antigen Production

Five cDNA libraries that had been produced from different human tissues (foetal brain, intestine, lung, liver and T-cells) were used for the production of the recombinant antigens. All cDNAs were expressed in *E. coli* under the transcriptional control of the lactose-inducible promoter.

The resultant proteins carry, at their amino terminus, an additional sequence for a hexahistidine purification tag (His6 tag). Target antigens which were not present in the cDNA library were produced by chemical synthesis (Life Technologies) and cloned into the expression vector pQE30-NST, which already codes an amino-terminal His6 tag.

Following recombinant expression of the proteins, these were isolated in denaturising conditions and purified by means of metal affinity chromatography (IMAC). The proteins were lyophilised and stored at −20° C. until further use.

Example 3: Production of Bead-Based Arrays (BBAs)

The production of BBAs was adapted to a microtitre plate format, such that 384 coupling reactions could be assessed in parallel using automated pipette systems (Starlet, Hamilton Robotics, Evo Freedom 150, Tecan). For the use of automated pipette systems, the individual bead regions were transferred into coupling plates (96 well Greiner) and the antigens were transferred into 2D barcode vessels (Thermo Scientific). For each coupling reaction, 0.6 to 2.5 million beads and, depending on the antigen, 1 to 100 µg protein were used.

All washing and pipetting steps of the coupling reaction were carried out in coupling plates which were fixed on magnets. The beads were washed twice with 100 µl L×AP buffer (100 mM $NaH_2PO_4$, pH 6.2) and then received in 120 µl L×AP buffer. For the activation, 15 µl 1-ethyl-3-(3-dimethylaminopropyl)carbodiimide (EDC; 50 mg/ml) and 15 µl N-hydroxysulfosuccinimide (sulfo-NHS; 50 mg/ml) were added by pipette to form a bead suspension, and these suspensions were then incubated for 20 minutes in the shaker (RT, 900 rpm, protected against light). The beads were then washed 3× with 150 µl L×KPT buffer and then the protein solution was added. Following an incubation period of two hours in the shaker (RT, 900 rpm, protected against light), the beads were then washed three times with 150 µl L×KPT buffer. To block free binding points, 100 µl L×CBSP buffer (PBS, 1% BSA, 0.05% ProClin300) were added, and these mixtures were then incubated for 20 min in the shaker (RT, 900 rpm, protected against light). This was followed by incubation over night at 4-8° C. The BBA was produced by the combination of beads coupled to antigens and was stored at 4-8° C., protected against light, until use.

Example 4: Application of BBAs

For application, BBAs were incubated with sera and all IgG-based autoantibodies bonded to antigens were detected with the aid of a secondary antibody. In order to enable a high throughput of measurements, the application of BBAs was adapted to a microtitre plate format so that either an 8-channel (Starlet, Hamilton Robotics) or a 96-channel (Evo Freedom 150, Tecan) automated pipetting system could be used. The sera to be examined were transferred into 2D barcode vessels and then diluted 1:100 with assay buffer (PBS, 0.5% BSA, 10% *E. coli* lysate, 50% low-cross buffer (Candor Technologies)). In order to neutralise human antibodies directed against *E. coli*, a pre-incubation of the sera dilutions was performed for 20 min. In this time, 500 beads per bead region were distributed in the assay plate. 50 µl of diluted serum were added to the beads in the coupling plate, and the reaction mixtures were incubated for 18-22 h in the shaker (4-8° C., 900 rpm, protected against light). After three washing steps in each case with 100 µl L×WPT buffer, 5 µg/ml of the detection antibody goat anti-human IgG-PE (Dianova) were added to the reaction mixtures and incubated for 1 h in the shaker (RT, 900 rpm). The beads were then washed three times with 100 µl L×WPT and incorporated in 100 µl carrier liquid (Luminex). The fluorescence signal of the beads was detected with the aid of the FlexMAP3D instrument. Here, the bead count on the one hand and the MFI value (median fluorescence intensity) on the other hand were measured.

Example 5: Biostatistical Analysis

The biostatistical analysis comprised univariate and multivariate methods for describing the statistical properties of individual antigens and of groups of antigens. In order to discover interesting candidates for panels, the key property was a good separation between the groups of samples based on the MFI values. In order to find antigen candidates for panel generation, univariate testing, receiver operating characteristic (ROC) analyses, correlation profiles, powered partial least squares discriminant analysis (PPLS-DA) and random forests were used as methods. Biostatistical analyses were subject to expert assessment in order to define final antigen panels.

Before the statistical analysis, the MFI values of log2-transformed antigens in which more than 20% of the values were missing were excluded from the analysis, and missing values were replaced by median imputation. A quantile normalisation was carried out under consideration of the reference sera in order to normalise, per BBA set, all measured samples on individual plates.

Besides descriptive standardisation for MFI values, non-parametric tests were also carried out with the aid of the two-sided Mann-Whitney-U test in order to uncover differences in the median values of the groups. The test level for multiple testing was corrected in accordance with the Bonferroni-Holm procedure. In addition, the Benjamin-Hochberg procedure inclusive of the determination of the False Discovery Rate (FDR, q-value) was applied. In addition, fold-change and effect size were determined. In order to assess the classification quality, an ROC analysis was carried out, within the scope of which sensitivity, specificity and the area under the ROC curve (AUC) were calculated, in each case inclusive of the 95% confidence interval on the basis of the bootstrap method. Boxplots and volcano plots were used for graphical representation. A scoring system was implemented on the basis of the univariate results.

By means of the application of a PPLS-DA, it was attempted to maximise the correlation between the components and the response matrix. A linear discriminant analysis with the latent component as predictors was used for the final classification. A random forest was applied, in which binary decision trees are combined. The decision trees were formed on the basis of a number of bootstrap samples of a training sample and by random selection of a subgroup of explaining variables at each node. The number of input variables, which was selected randomly with each division step, was determined as the square root of the total number of variables, and the number of trees in the random forest was set to 1000. A cross validation with 500 times throughput was implemented for both multi-variant approaches.

Example 6: Autoantibodies/Antigen Reactivities Differentiate SSc From Healthy Controls, SLE, Rheumatoid Arthritis and Other Autoimmune Diseases (AIDs)

In a first screening the antigen reactivities of 100 SSc patients, 537 patients with early RA, 82 patients with SPA, and 343 healthy controls categorised in accordance with age and sex were differentially tested. For this purpose, the autoantibody reactivities of these blood samples were tested on 5857 antigens coupled to Luminex beads.

Figure 1:
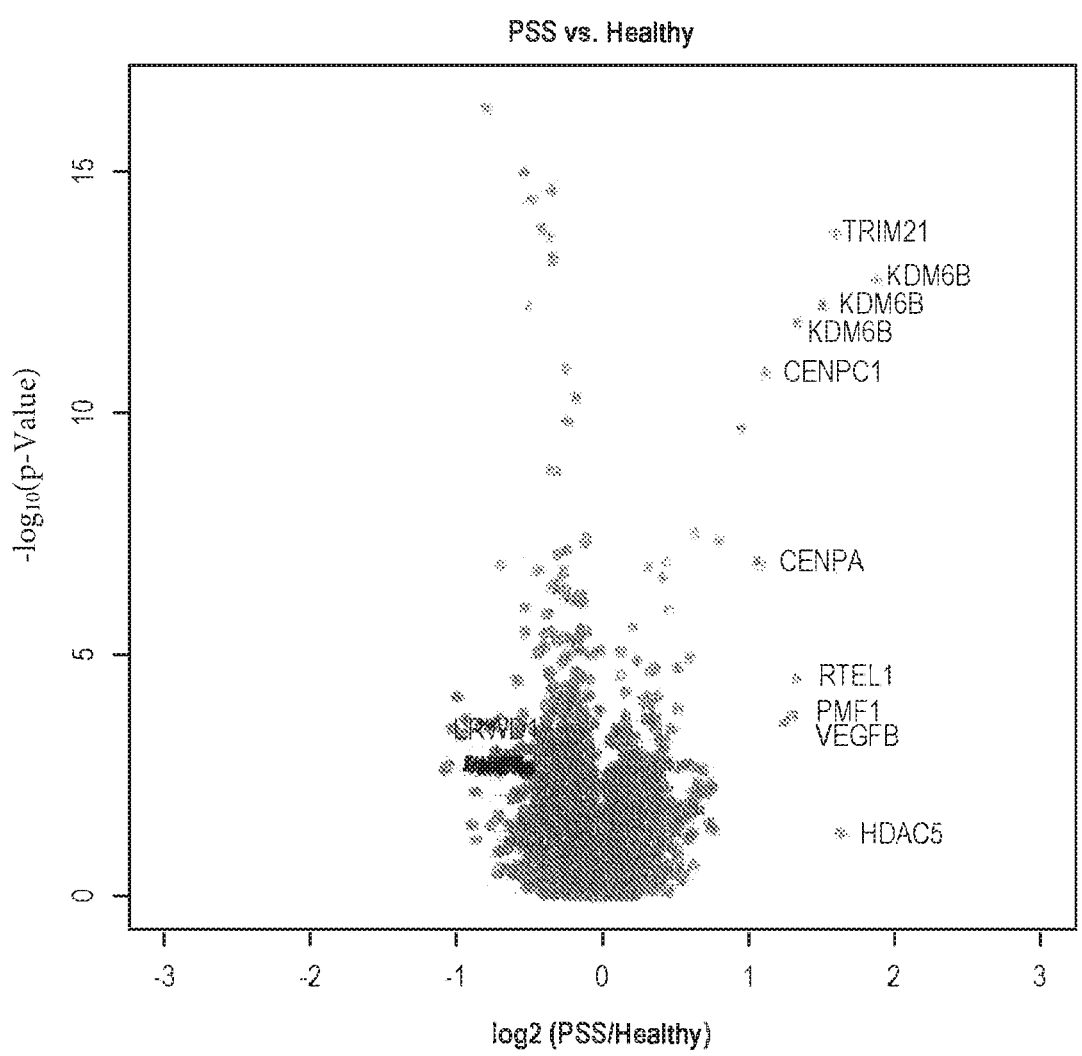
FIG. 1 shows a volcano plot of the relative antigen reactivities of the SSc patients compared to healthy controls.
Figure 2:
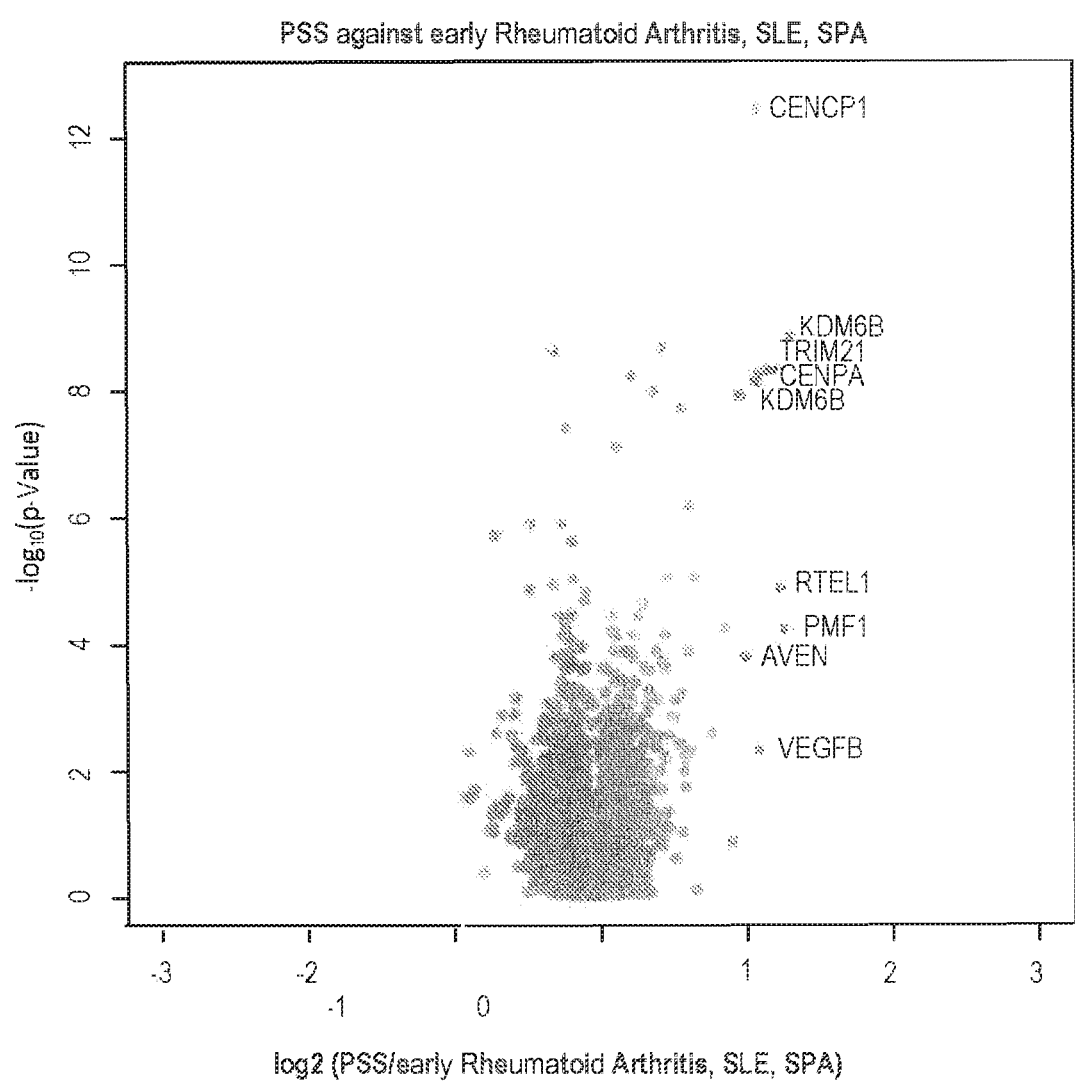
FIG. 2 shows a volcano plot of the antigen reactivities of the SSc patients compared to a combined group of patients with different autoimmune diseases such as SSC, SPA, early rheumatoid arthritis and SPA.

In order to identify antigens with which the group of all SSc patients can be distinguished from different control groups consisting of healthy samples and patients with various rheumatic diseases, univariate statistical tests were carried out. The result of the statistical test is illustrated as a volcano plot for all 5857 antigens. In the volcano plot, the x-axis shows the relative change of the antigen reactivity in SSc patients compared with healthy controls (FIG. 1) and AID patients (FIG. 2). The y-axis presents the p-value of the statistical tests. FIGS. 1 and 2 show that specific autoantibody reactivities were found which are increased in the group of all SSc and which can distinguish both from healthy donors and from patients with rheumatic diseases.

Table 2 comprises all autoantigens identified in SSc patients (Table 2)).

TABLE 2

Summary of the (auto)antigens identified in SSc (also referred to as "markers" or "biomarkers")
What is specified is the sequential sequence ID, the gene ID, gene symbol, and the gene name. The group denotes the use of the biomarker for the identification of all SSc patients or specific SSc subgroups on the basis of a statistical threshold value of p < 0.05 and relatively higher reactivity (fold-change) compared to the control group of greater than 1.5.
Group 1: Markers for identification of all SSc patients regardless of the clinical subform;
Group 2: Markers for identification of diffuse SSc (dSSc);
Group 3: Markers for identification of limited SSc (lSSc);
Group 4: Markers for identification of SSc overlap syndrome (overlap syndrome; SSc-OS) and
Group 5: additional markers which are not assigned to any specific group.

| SEQ ID No. | Gene ID | Gene Symbol | Gene Name | Group | $p < 0.05$ and fold-change > 1.5 in group |
|---|---|---|---|---|---|
| | | | Primary antigens/Primary markers | | |
| 1 | 23135 | KDM6B | lysine (K)-specific demethylase 6B | 1 | SSc; dSSc; lSSc; SSc-OS |
| 2 | 23299 | BICD2 | bicaudal D homolog 2 (*Drosophila*) | 3 | lSSc |
| 3 | 55695 | NSUN5 | NOL1/NOP2/Sun domain family, member 5 | 1 | SSc; lSSc |
| 4 | 51750 | RTEL1 | regulator of telomere elongation helicase 1 | 1 | SSc; lSSc |
| 5 | 11143 | MYST2 | MYST histone acetyltransferase 2 | 1 | SSc; dSSc |
| 6 | 29968 | PSAT1 | phosphoserine aminotransferase 1 | 2 | dSSc |
| 7 | 51368 | TEX264 | testis expressed 264 | 2 | dSSc |
| | | | Preferred antigens/preferred markers | | |
| 8 | 6737 | TRIM21 | tripartite motif containing 21 | 1 | SSc; dSSc; SSc-OS; lSSc |
| 9 | 11194 | ABCB8 | ATP-binding cassette, sub-family B (MDR/TAP), member 8 | 1 | SSc; lSSc |
| 10 | 57099 | AVEN | apoptosis, caspase activation inhibitor | 1 | SSc; lSSc |
| 11 | 7423 | VEGFB | vascular endothelial growth factor B | 1 | SSc; dSSc; lSSc; SSc-OS |
| 12 | 55049 | C19orf60 | chromosome 19 open reading frame 60 | 1 | SSc |
| 13 | 1058 | CENPA | centromere protein A | 1 | SSc; lSSc; |
| 14 | 1060 | CENPC1 | centromere protein C 1 | 1 | SSc; lSSc; dSSc |
| 15 | 80152 | CENPT | centromere protein T | 1 | SSc; lSSc |
| 16 | 1131 | CHRM3 | cholinergic receptor, muscarinic 3 | 1 | SSc; lSSc; SSc-OS |
| 17 | 64689 | GORASP1 | golgi reassembly stacking protein 1, 65 kDa | 1 | SSc; SSc-OS |
| 18 | 2997 | GYS1 | glycogen synthase 1 (muscle) | 1 | SSc; lSSc |
| 19 | 10014 | HDAC5 | histone deacetylase 5 | 1 | SSc |

TABLE 2-continued

Summary of the (auto)antigens identified in SSc (also referred to as "markers" or "biomarkers")
What is specified is the sequential sequence ID, the gene ID, gene symbol, and the gene name. The group denotes the use of the biomarker for the identification of all SSc patients or specific SSc subgroups on the basis of a statistical threshold value of $p < 0.05$ and relatively higher reactivity (fold-change) compared to the control group of greater than 1.5.
Group 1: Markers for identification of all SSc patients regardless of the clinical subform;
Group 2: Markers for identification of diffuse SSc (dSSc);
Group 3: Markers for identification of limited SSc (lSSc);
Group 4: Markers for identification of SSc overlap syndrome (overlap syndrome; SSc-OS) and
Group 5: additional markers which are not assigned to any specific group.

| SEQ ID No. | Gene ID | Gene Symbol | Gene Name | Group | $p < 0.05$ and fold-change > 1.5 in group |
|---|---|---|---|---|---|
| 20 | 80895 | ILKAP | integrin-linked kinase-associated serine/threonine phosphatase 2C | 1 | SSc; lSSc |
| 21 | 27257 | LSM1 | LSM1 homolog, U6 small nuclear RNA associated (S. cerevisiae) | 1 | SSc |
| 22 | 153562 | MARVELD2 | MARVEL domain containing 2 | 1 | SSc; lSSc |
| 23 | 4784 | NFIX | nuclear factor I/X (CCAAT-binding transcription factor) | 1 | SSc; lSSc |
| 24 | 23762 | OSBP2 | oxysterol binding protein 2 | 1 | SSc; lSSc |
| 25 | 415116 | PIM3 | pim-3 oncogene | 1 | SSc |
| 26 | 5364 | PLXNB1 | plexin B1 | 1 | SSc; |
| 27 | 11243 | PMF1 | polyamine-modulated factor 1 | 1 | SSc; dSSc; lSSc |
| 28 | 10450 | PPIE | peptidylprolyl isomerase E (cyclophilin E) | 1 | SSc; dSSc; SSc-OS |
| 29 | 63976 | PRDM16 | PR domain containing 16 | 1 | SSc |
| 30 | 26140 | TTLL3 | tubulin tyrosine ligase-like family, member 3 | 1 | SSc; dSSc; |
| 31 | 84196 | USP48 | ubiquitin specific peptidase 48 | 1 | SSc |
| 32 | 563 | AZGP1 | alpha-2-glycoprotein 1, zinc-binding | 1 | SSc; dSSc; lSSc; SSc-OS |
| 33 | 7791 | ZYX | zyxin | 1 | SSc; dSSc; |
| 34 | 55324 | ABCF3 | ATP-binding cassette, sub-family F (GCN20), member 3 | 2 | dSSc |
| 35 | 39 | ACAT2 | acetyl-Coenzyme A acetyltransferase 2 | 2 | dSSc |
| 36 | 79921 | TCEAL4 | transcription elongation factor A (SII)-like 4 | 2 | dSSc |
| 37 | 81 | ACTN4 | actinin, alpha 4 | 2 | dSSc |
| 38 | 79913 | ACTR5 | ARP5 actin-related protein 5 homolog (yeast) | 2 | dSSc |
| 39 | 216 | ALDH1A1 | aldehyde dehydrogenase 1 family, member A1 | 2 | dSSc |
| 40 | 80216 | ALPK1 | alpha-kinase 1 | 2 | dSSc |
| 41 | 321 | APBA2 | amyloid beta (A4) precursor protein-binding, family A, member 2 | 2 | dSSc |
| 42 | 27237 | ARHGEF16 | Rho guanine exchange factor (GEF) 16 | 2 | dSSc |
| 43 | 8623 | ASMTL | acetylserotonin O-methyltransferase-like | 2 | dSSc |
| 44 | 23400 | ATP13A2 | ATPase type 13A2 | 2 | dSSc |
| 45 | 56946 | C11orf30 | chromosome 11 open reading frame 30 | 2 | dSSc |

TABLE 2-continued

Summary of the (auto)antigens identified in SSc (also referred to as "markers" or "biomarkers")
What is specified is the sequential sequence ID, the gene ID, gene symbol, and the gene name. The group denotes the use of the biomarker for the identification of all SSc patients or specific SSc subgroups on the basis of a statistical threshold value of $p < 0.05$ and relatively higher reactivity (fold-change) compared to the control group of greater than 1.5.
Group 1: Markers for identification of all SSc patients regardless of the clinical subform;
Group 2: Markers for identification of diffuse SSc (dSSc);
Group 3: Markers for identification of limited SSc (lSSc);
Group 4: Markers for identification of SSc overlap syndrome (overlap syndrome; SSc-OS) and
Group 5: additional markers which are not assigned to any specific group.

| SEQ ID No. | Gene ID | Gene Symbol | Gene Name | Group | $p < 0.05$ and fold-change > 1.5 in group |
|---|---|---|---|---|---|
| 46 | 56912 | C11orf60 | chromosome 11 open reading frame 60 | 2 | dSSc |
| 47 | 56985 | C17orf48 | chromosome 17 open reading frame 48 | 2 | dSSc |
| 48 | 90580 | C19orf52 | chromosome 19 open reading frame 52 | 2 | dSSc |
| 49 | 51507 | C20orf43 | chromosome 20 open reading frame 43 | 2 | dSSc |
| 50 | 55755 | CDK5RAP2 | CDK5 regulatory subunit associated protein 2 | 2 | dSSc |
| 51 | 51727 | CMPK1 | cytidine monophosphate (UMP-CMP) kinase 1, cytosolic | 2 | dSSc |
| 52 | 10391 | CORO2B | coronin, actin binding protein, 2B | 2 | dSSc |
| 53 | 9377 | COX5A | cytochrome c oxidase subunit Va | 2 | dSSc |
| 54 | 1488 | CTBP2 | C-terminal binding protein 2 | 2 | dSSc |
| 55 | 8529 | CYP4F2 | cytochrome P450, family 4, subfamily F, polypeptide 2 | 2 | dSSc |
| 56 | 9909 | DENND4B | DENN/MADD domain containing 4B | 2 | dSSc |
| 57 | 10901 | DHRS4 | dehydrogenase/reductase (SDR family) member 4 | 2 | dSSc |
| 58 | 84062 | DTNBP1 | dystrobrevin binding protein 1 | 2 | dSSc |
| 59 | 1936 | EEF1D | eukaryotic translation elongation factor 1 delta (guanine nucleotide exchange protein) | 2 | dSSc |
| 60 | 8891 | EIF2B3 | eukaryotic translation initiation factor 2B, subunit 3 gamma, 58 kDa | 2 | dSSc |
| 61 | 64787 | EPS8L2 | EPS8-like 2 | 2 | dSSc |
| 62 | 9638 | FEZ1 | fasciculation and elongation protein zeta 1 (zygin I) | 2 | dSSc |
| 63 | 2300 | FOXL1 | forkhead box L1 | 2 | dSSc |
| 64 | 2519 | FUCA2 | fucosidase, alpha-L-2, plasma | 2 | dSSc |
| 65 | 79690 | GAL3ST4 | galactose-3-O-sulfotransferase 4 | 2 | dSSc |
| 66 | 54960 | GEMIN8 | gem (nuclear organelle) associated protein 8 | 2 | dSSc |
| 67 | 51031 | GLOD4 | glyoxalase domain containing 4 | 2 | dSSc |
| 68 | 2934 | GSN | gelsolin (amyloidosis, Finnish type) | 2 | dSSc |
| 69 | 3157 | HMGCS1 | 3-hydroxy-3-methylglutaryl-Coenzyme A synthase 1 (soluble) | 2 | dSSc |
| 70 | 3320 | HSP90AA1 | heat shock protein 90 kDa alpha (cytosolic), class A member 1 | 2 | dSSc |

TABLE 2-continued

Summary of the (auto)antigens identified in SSc (also referred to as "markers" or "biomarkers")
What is specified is the sequential sequence ID, the gene ID, gene symbol, and the gene name. The group denotes the use of the biomarker for the identification of all SSc patients or specific SSc subgroups on the basis of a statistical threshold value of p < 0.05 and relatively higher reactivity (fold-change) compared to the control group of greater than 1.5.
Group 1: Markers for identification of all SSc patients regardless of the clinical subform;
Group 2: Markers for identification of diffuse SSc (dSSc);
Group 3: Markers for identification of limited SSc (lSSc);
Group 4: Markers for identification of SSc overlap syndrome (overlap syndrome; SSc-OS) and
Group 5: additional markers which are not assigned to any specific group.

| SEQ ID No. | Gene ID | Gene Symbol | Gene Name | Group | p < 0.05 and fold-change > 1.5 in group |
|---|---|---|---|---|---|
| 71 | 3633 | INPP5B | inositol polyphosphate-5-phosphatase, 75 kDa | 2 | dSSc |
| 72 | 3654 | IRAK1 | interleukin-1 receptor-associated kinase 1 | 2 | dSSc |
| 73 | 23479 | ISCU | iron-sulfur cluster scaffold homolog (*E. coli*) | 2 | dSSc |
| 74 | 51520 | LARS | leucyl-tRNA synthetase | 2 | dSSc |
| 75 | 4057 | LTF | lactotransferrin | 2 | dSSc |
| 76 | 10724 | MGEA5 | meningioma expressed antigen 5 (hyaluronidase) | 2 | dSSc |
| 77 | 84954 | MPND | MPN domain containing | 2 | dSSc |
| 78 | 4437 | MSH3 | mutS homolog 3 (*E. coli*) | 2 | dSSc |
| 79 | 23385 | NCSTN | nicastrin | 2 | dSSc |
| 80 | 4758 | NEU1 | sialidase 1 (lysosomal sialidase) | 2 | dSSc |
| 81 | 5034 | P4HB | prolyl 4-hydroxylase, beta polypeptide | 2 | dSSc |
| 82 | 5187 | PER1 | period homolog 1 (*Drosophila*) | 2 | dSSc |
| 83 | 5195 | PEX14 | peroxisomal biogenesis factor 14 | 2 | dSSc |
| 84 | 10404 | PGCP | plasma glutamate carboxypeptidase | 2 | dSSc |
| 85 | 5493 | PPL | periplakin | 2 | dSSc |
| 86 | 5575 | PRKAR1B | protein kinase, cAMP-dependent, regulatory, type I, beta | 2 | dSSc |
| 87 | 84867 | PTPN5 | protein tyrosine phosphatase, non-receptor type 5 (striatum-enriched) | 2 | dSSc |
| 88 | 9230 | RAB11B | RAB11B, member RAS oncogene family | 2 | dSSc |
| 89 | 84440 | RAB11FIP4 | RAB11 family interacting protein 4 (class II) | 2 | dSSc |
| 90 | 10900 | RUNDC3A | RUN domain containing 3A | 2 | dSSc |
| 91 | 50861 | STMN3 | stathmin-like 3 | 2 | dSSc |
| 92 | 81551 | STMN4 | stathmin-like 4 | 2 | dSSc |
| 93 | 6814 | STXBP3 | syntaxin binding protein 3 | 2 | dSSc |
| 94 | 93426 | SYCE1 | synaptonemal complex central element protein 1 | 2 | dSSc |
| 95 | 6904 | TBCD | tubulin folding cofactor D | 2 | dSSc |
| 96 | 7110 | TMF1 | TATA element modulatory factor 1 | 2 | dSSc |
| 97 | 10102 | TSFM | Ts translation elongation factor, mitochondrial | 2 | dSSc |
| 98 | 7296 | TXNRD1 | thioredoxin reductase 1 | 2 | dSSc |
| 99 | 55585 | UBE2Q1 | ubiquitin-conjugating enzyme E2Q family member 1 | 2 | dSSc |

TABLE 2-continued

Summary of the (auto)antigens identified in SSc (also referred to as "markers" or "biomarkers") What is specified is the sequential sequence ID, the gene ID, gene symbol, and the gene name. The group denotes the use of the biomarker for the identification of all SSc patients or specific SSc subgroups on the basis of a statistical threshold value of $p < 0.05$ and relatively higher reactivity (fold-change) compared to the control group of greater than 1.5.
Group 1: Markers for identification of all SSc patients regardless of the clinical subform;
Group 2: Markers for identification of diffuse SSc (dSSc);
Group 3: Markers for identification of limited SSc (lSSc);
Group 4: Markers for identification of SSc overlap syndrome (overlap syndrome; SSc-OS) and
Group 5: additional markers which are not assigned to any specific group.

| SEQ ID No. | Gene ID | Gene Symbol | Gene Name | Group | $p < 0.05$ and fold-change > 1.5 in group |
|---|---|---|---|---|---|
| 100 | 92912 | UBE2Q2 | ubiquitin-conjugating enzyme E2Q family member 2 | 2 | dSSc |
| 101 | 65264 | UBE2Z | ubiquitin-conjugating enzyme E2Z | 2 | dSSc |
| 102 | 54915 | YTHDF1 | YTH domain family, member 1 | 2 | dSSc |
| 103 | 7764 | ZNF217 | zinc finger protein 217 | 2 | dSSc |
| 104 | 10290 | SPEG | SPEG complex locus | 3 | lSSc |
| 105 | 84936 | ZFYVE19 | zinc finger, FYVE domain containing 19 | 3 | lSSc |
| 106 | 26574 | AATF | apoptosis antagonizing transcription factor | 3 | lSSc |
| 107 | 10152 | ABI2 | abl-interactor 2 | 3 | lSSc |
| 108 | 84320 | ACBD6 | acyl-Coenzyme A binding domain containing 6 | 3 | lSSc |
| 109 | 9049 | AIP | aryl hydrocarbon receptor interacting protein | 3 | lSSc |
| 110 | 286 | ANK1 | ankyrin 1, erythrocytic | 3 | lSSc |
| 111 | 396 | ARHGDIA | Rho GDP dissociation inhibitor (GDI) alpha | 3 | lSSc |
| 112 | 51582 | AZIN1 | antizyme inhibitor 1 | 3 | lSSc |
| 113 | 128061 | C1orf131 | chromosome 1 open reading frame 131 | 3 | lSSc |
| 114 | 79095 | C9orf16 | chromosome 9 open reading frame 16 | 3 | lSSc |
| 115 | 11335 | CBX3 | chromobox homolog 3 (HP1 gamma homolog, *Drosophila*) | 3 | lSSc |
| 116 | 92922 | CCDC102A | coiled-coil domain containing 102A | 3 | lSSc |
| 117 | 23582 | CCNDBP1 | cyclin D-type binding-protein 1 | 3 | lSSc |
| 118 | 64946 | CENPH | centromere protein H | 3 | lSSc |
| 119 | 79585 | CORO7 | coronin 7 | 3 | lSSc |
| 120 | 1653 | DDX1 | DEAD (Asp-Glu-Ala-Asp) box polypeptide 1 | 3 | lSSc |
| 121 | 23220 | DTX4 | deltex homolog 4 (*Drosophila*) | 3 | lSSc |
| 122 | 51143 | DYNC1LI1 | dynein, cytoplasmic 1, light intermediate chain 1 | 3 | lSSc |
| 123 | 1977 | EIF4E | eukaryotic translation initiation factor 4E | 3 | lSSc |
| 124 | 256364 | EML3 | echinoderm microtubule associated protein like 3 | 3 | lSSc |
| 125 | 55740 | ENAH | enabled homolog (*Drosophila*) | 3 | lSSc |
| 126 | 8320 | EOMES | eomesodermin homolog (Xenopus laevis) | 3 | lSSc |
| 127 | 9130 | FAM50A | family with sequence similarity 50, member A | 3 | lSSc |
| 128 | 89848 | FCHSD1 | FCH and double SH3 domains 1 | 3 | lSSc |
| 129 | 2549 | GAB1 | GRB2-associated binding protein 1 | 3 | lSSc |

TABLE 2-continued

Summary of the (auto)antigens identified in SSc (also referred to as "markers" or "biomarkers")
What is specified is the sequential sequence ID, the gene ID, gene symbol, and the gene name. The group denotes the use of the biomarker for the identification of all SSc patients or specific SSc subgroups on the basis of a statistical threshold value of p < 0.05 and relatively higher reactivity (fold-change) compared to the control group of greater than 1.5.
Group 1: Markers for identification of all SSc patients regardless of the clinical subform;
Group 2: Markers for identification of diffuse SSc (dSSc);
Group 3: Markers for identification of limited SSc (lSSc);
Group 4: Markers for identification of SSc overlap syndrome (overlap syndrome; SSc-OS) and
Group 5: additional markers which are not assigned to any specific group.

| SEQ ID No. | Gene ID | Gene Symbol | Gene Name | Group | $p < 0.05$ and fold-change > 1.5 in group |
|---|---|---|---|---|---|
| 130 | 2653 | GCSH | glycine cleavage system protein H (aminomethyl carrier) | 3 | lSSc |
| 131 | 10755 | GIPC1 | GIPC PDZ domain containing family, member 1 | 3 | lSSc |
| 132 | 28964 | GIT1 | G protein-coupled receptor kinase interacting ArfGAP 1 | 3 | lSSc |
| 133 | 65056 | GPBP1 | GC-rich promoter binding protein 1 | 3 | lSSc |
| 134 | 2962 | GTF2F1 | general transcription factor IIF, polypeptide 1, 74 kDa | 3 | lSSc |
| 135 | 3024 | HIST1H1A | histone cluster 1, H1a | 3 | lSSc |
| 136 | 3551 | IKBKB | inhibitor of kappa light polypeptide gene enhancer in B-cells, kinase beta | 3 | lSSc |
| 137 | 57461 | ISY1 | ISY1 splicing factor homolog (S. cerevisiae) | 3 | lSSc |
| 138 | 3791 | KDR | kinase insert domain receptor (a type III receptor tyrosine kinase) | 3 | lSSc |
| 139 | 22920 | KIFAP3 | kinesin-associated protein 3 | 3 | lSSc |
| 140 | 4137 | MAPT | microtubule-associated protein tau | 3 | lSSc |
| 141 | 9412 | MED21 | mediator complex subunit 21 | 3 | lSSc |
| 142 | 55034 | MOCOS | molybdenum cofactor sulfurase | 3 | lSSc |
| 143 | 64981 | MRPL34 | mitochondrial ribosomal protein L34 | 3 | lSSc |
| 144 | 55968 | NSFL1C | NSFL1 (p97) cofactor (p47) | 3 | lSSc |
| 145 | 10130 | PDIA6 | protein disulfide isomerase family A, member 6 | 3 | lSSc |
| 146 | 55857 | PLK1S1 | polo-like kinase 1 substrate 1 | 3 | lSSc |
| 147 | 23654 | PLXNB2 | plexin B2 | 3 | lSSc |
| 148 | 6004 | RGS16 | regulator of G-protein signaling 16 | 3 | lSSc |
| 149 | 6047 | RNF4 | ring finger protein 4 | 3 | lSSc |
| 150 | 6125 | RPL5 | ribosomal protein L5 | 3 | lSSc |
| 151 | 6285 | S100B | S100 calcium binding protein B | 3 | lSSc |
| 152 | 6418 | SET | SET nuclear oncogene | 3 | lSSc |
| 153 | 6421 | SFPQ | splicing factor proline/glutamine-rich (polypyrimidine tract binding protein associated) | 3 | lSSc |
| 154 | 6456 | SH3GL2 | SH3-domain GRB2-like 2 | 3 | lSSc |
| 155 | 1059 | CENPB | centromere protein B, 80 kDa | 3 | lSSc |

TABLE 2-continued

Summary of the (auto)antigens identified in SSc (also referred to as "markers" or "biomarkers")
What is specified is the sequential sequence ID, the gene ID, gene symbol, and the gene name. The group denotes the use of the biomarker for the identification of all SSc patients or specific SSc subgroups on the basis of a statistical threshold value of p < 0.05 and relatively higher reactivity (fold-change) compared to the control group of greater than 1.5.
Group 1: Markers for identification of all SSc patients regardless of the clinical subform;
Group 2: Markers for identification of diffuse SSc (dSSc);
Group 3: Markers for identification of limited SSc (lSSc);
Group 4: Markers for identification of SSc overlap syndrome (overlap syndrome; SSc-OS) and
Group 5: additional markers which are not assigned to any specific group.

| SEQ ID No. | Gene ID | Gene Symbol | Gene Name | Group | $p < 0.05$ and fold-change > 1.5 in group |
|---|---|---|---|---|---|
| 172 | 255626 | HIST1H2BA | histone cluster 1, H2ba | 5 | lSSc; SSc-OS |
| 156 | 84501 | SPIRE2 | spire homolog 2 (Drosophila) | 3 | lSSc |
| 157 | 6709 | SPTAN1 | spectrin, alpha, non-erythrocytic 1 (alpha-fodrin) | 3 | lSSc |
| 158 | 6741 | SSB | Sjogren syndrome antigen B (autoantigen La) | 3 | lSSc |
| 159 | 25949 | SYF2 | SYF2 homolog, RNA splicing factor (S. cerevisiae) | 3 | lSSc |
| 160 | 6880 | TAF9 | TAF9 RNA polymerase II, TATA box binding protein (TBP)-associated factor, 32 kDa | 3 | lSSc |
| 161 | 11022 | TDRKH | tudor and KH domain containing | 3 | lSSc |
| 162 | 7265 | TTC1 | tetratricopeptide repeat domain 1 | 3 | lSSc |
| 163 | 23331 | TTC28 | tetratricopeptide repeat domain 28 | 3 | lSSc |
| 164 | 11344 | TWF2 | twinfilin, actin-binding protein, homolog 2 (Drosophila) | 3 | lSSc |
| 165 | 55833 | UBAP2 | ubiquitin associated protein 2 | 3 | lSSc |
| 166 | 9094 | UNC119 | unc-119 homolog (C. elegans) | 3 | lSSc |
| 167 | 58525 | WIZ | widely interspaced zinc finger motifs | 3 | lSSc |
| 168 | 7494 | XBP1 | X-box binding protein 1 | 3 | lSSc |
| 169 | 56252 | YLPM1 | YLP motif containing 1 | 3 | lSSc |
| 170 | 51538 | ZCCHC17 | zinc finger, CCHC domain containing 17 | 3 | lSSc |
| 171 | 84240 | ZCCHC9 | zinc finger, CCHC domain containing 9 | 3 | lSSc |
| 173 | 11332 | ACOT7 | acyl-CoA thioesterase 7 | 4 | SSc-OS |
| 174 | 10120 | ACTR1B | ARP1 actin-related protein 1 homolog B, centractin beta (yeast) | 4 | SSc-OS |
| 175 | 118 | ADD1 | adducin 1 (alpha) | 4 | SSc-OS |
| 176 | 9131 | AIFM1 | apoptosis-inducing factor, mitochondrion-associated, 1 | 4 | SSc-OS |
| 177 | 203 | AK1 | adenylate kinase 1 | 4 | SSc-OS |
| 178 | 8165 | AKAP1 | A kinase (PRKA) anchor protein 1 | 4 | SSc-OS |
| 179 | 207 | AKT1 | v-akt murine thymoma viral oncogene homolog 1 | 4 | SSc-OS |
| 180 | 29945 | ANAPC4 | anaphase promoting complex subunit 4 | 4 | SSc-OS |
| 181 | 54522 | ANKRD16 | ankyrin repeat domain 16 | 4 | SSc-OS |

TABLE 2-continued

Summary of the (auto)antigens identified in SSc (also referred to as "markers" or "biomarkers") What is specified is the sequential sequence ID, the gene ID, gene symbol, and the gene name. The group denotes the use of the biomarker for the identification of all SSc patients or specific SSc subgroups on the basis of a statistical threshold value of $p < 0.05$ and relatively higher reactivity (fold-change) compared to the control group of greater than 1.5.
Group 1: Markers for identification of all SSc patients regardless of the clinical subform;
Group 2: Markers for identification of diffuse SSc (dSSc);
Group 3: Markers for identification of limited SSc (lSSc);
Group 4: Markers for identification of SSc overlap syndrome (overlap syndrome; SSc-OS) and
Group 5: additional markers which are not assigned to any specific group.

| SEQ ID No. | Gene ID | Gene Symbol | Gene Name | Group | $p < 0.05$ and fold-change > 1.5 in group |
|---|---|---|---|---|---|
| 182 | 203286 | ANKS6 | ankyrin repeat and sterile alpha motif domain containing 6 | 4 | SSc-OS |
| 183 | 324 | APC | adenomatous polyposis coli | 4 | SSc-OS |
| 184 | 397 | ARHGDIB | Rho GDP dissociation inhibitor (GDI) beta | 4 | SSc-OS |
| 185 | 140459 | ASB6 | ankyrin repeat and SOCS box-containing 6 | 4 | SSc-OS |
| 186 | 513 | ATP5D | ATP synthase, H + transporting, mitochondrial F1 complex, delta subunit | 4 | SSc-OS |
| 187 | 10476 | ATP5H | ATP synthase, H + transporting, mitochondrial F0 complex, subunit d | 4 | SSc-OS |
| 188 | 60370 | AVPI1 | arginine vasopressin-induced 1 | 4 | SSc-OS |
| 189 | 146712 | B3GNTL1 | UDP-GlcNAc:betaGal beta-1,3-N-acetylglucosaminyltransferase-like 1 | 4 | SSc-OS |
| 190 | 593 | BCKDHA | branched chain keto acid dehydrogenase E1, alpha polypeptide | 4 | SSc-OS |
| 191 | 27154 | BRPF3 | bromodomain and PHD finger containing, 3 | 4 | SSc-OS |
| 192 | 64776 | C11orf1 | chromosome 11 open reading frame 1 | 4 | SSc-OS |
| 193 | 144097 | C11orf84 | chromosome 11 open reading frame 84 | 4 | SSc-OS |
| 194 | 55195 | C14orf105 | chromosome 14 open reading frame 105 | 4 | SSc-OS |
| 195 | 55257 | C20orf20 | chromosome 20 open reading frame 20 | 4 | SSc-OS |
| 196 | 51300 | C3orf1 | chromosome 3 open reading frame 1 | 4 | SSc-OS |
| 197 | 763 | CA5A | carbonic anhydrase VA, mitochondrial | 4 | SSc-OS |
| 198 | 794 | CALB2 | calbindin 2 | 4 | SSc-OS |
| 199 | 822 | CAPG | capping protein (actin filament), gelsolin-like | 4 | SSc-OS |
| 200 | 23624 | CBLC | Cas-Br-M (murine) ecotropic retroviral transforming sequence c | 4 | SSc-OS |
| 201 | 54862 | CC2D1A | coiled-coil and C2 domain containing 1A | 4 | SSc-OS |
| 202 | 339230 | CCDC137 | coiled-coil domain containing 137 | 4 | SSc-OS |
| 203 | 55036 | CCDC40 | coiled-coil domain containing 40 | 4 | SSc-OS |
| 204 | 124808 | CCDC43 | coiled-coil domain containing 43 | 4 | SSc-OS |
| 205 | 728642 | CDC2L2 | cell division cycle 2-like 2 (PITSLRE proteins) | 4 | SSc-OS |

TABLE 2-continued

Summary of the (auto)antigens identified in SSc (also referred to as "markers" or "biomarkers")
What is specified is the sequential sequence ID, the gene ID, gene symbol, and the gene name. The group denotes the use of the biomarker for the identification of all SSc patients or specific SSc subgroups on the basis of a statistical threshold value of p < 0.05 and relatively higher reactivity (fold-change) compared to the control group of greater than 1.5.
Group 1: Markers for identification of all SSc patients regardless of the clinical subform;
Group 2: Markers for identification of diffuse SSc (dSSc);
Group 3: Markers for identification of limited SSc (lSSc);
Group 4: Markers for identification of SSc overlap syndrome (overlap syndrome; SSc-OS) and
Group 5: additional markers which are not assigned to any specific group.

| SEQ ID No. | Gene ID | Gene Symbol | Gene Name | Group | p < 0.05 and fold-change > 1.5 in group |
|---|---|---|---|---|---|
| 206 | 79959 | CEP76 | centrosomal protein 76 kDa | 4 | SSc-OS |
| 207 | 55748 | CNDP2 | CNDP dipeptidase 2 (metallopeptidase M20 family) | 4 | SSc-OS |
| 208 | 116840 | CNTROB | centrobin, centrosomal BRCA2 interacting protein | 4 | SSc-OS |
| 209 | 8161 | COIL | coilin | 4 | SSc-OS |
| 210 | 1410 | CRYAB | crystallin, alpha B | 4 | SSc-OS |
| 211 | 1674 | DES | desmin | 4 | SSc-OS |
| 212 | 54505 | DHX29 | DEAH (Asp-Glu-Ala-His) box polypeptide 29 | 4 | SSc-OS |
| 213 | 22982 | DIP2C | DIP2 disco-interacting protein 2 homolog C (Drosophila) | 4 | SSc-OS |
| 214 | 1810 | DR1 | down-regulator of transcription 1, TBP-binding (negative cofactor 2) | 4 | SSc-OS |
| 215 | 23741 | EID1 | EP300 interacting inhibitor of differentiation 1 | 4 | SSc-OS |
| 216 | 10613 | ERLIN1 | ER lipid raft associated 1 | 4 | SSc-OS |
| 217 | 90736 | FAM104B | family with sequence similarity 104, member B | 4 | SSc-OS |
| 218 | 58516 | FAM60A | family with sequence similarity 60, member A | 4 | SSc-OS |
| 219 | 2194 | FASN | fatty acid synthase | 4 | SSc-OS |
| 220 | 2209 | FCGR1A | Fc fragment of IgG, high affinity Ia, receptor (CD64) | 4 | SSc-OS |
| 221 | 23307 | FKBP15 | FK506 binding protein 15, 133 kDa | 4 | SSc-OS |
| 222 | 23770 | FKBP8 | FK506 binding protein 8, 38 kDa | 4 | SSc-OS |
| 223 | 8939 | FUBP3 | far upstream element (FUSE) binding protein 3 | 4 | SSc-OS |
| 224 | 26515 | FXC1 | fracture callus 1 homolog (rat) | 4 | SSc-OS |
| 225 | 2954 | GSTZ1 | glutathione transferase zeta 1 | 4 | SSc-OS |
| 226 | 94239 | H2AFV | H2A histone family, member V | 4 | SSc-OS |
| 227 | 3178 | HNRNPA1 | heterogeneous nuclear ribonucleoprotein A1 | 4 | SSc-OS |
| 228 | 92906 | HNRPLL | heterogeneous nuclear ribonucleoprotein L-like | 4 | SSc-OS |
| 229 | 440498 | HSBP1L1 | heat shock factor binding protein 1-like 1 | 4 | SSc-OS |
| 230 | 3312 | HSPA8 | heat shock 70 kDa protein 8 | 4 | SSc-OS |

TABLE 2-continued

Summary of the (auto)antigens identified in SSc (also referred to as "markers" or "biomarkers")
What is specified is the sequential sequence ID, the gene ID, gene symbol, and the gene name. The group denotes the use of the biomarker for the identification of all SSc patients or specific SSc subgroups on the basis of a statistical threshold value of p < 0.05 and relatively higher reactivity (fold-change) compared to the control group of greater than 1.5.
Group 1: Markers for identification of all SSc patients regardless of the clinical subform;
Group 2: Markers for identification of diffuse SSc (dSSc);
Group 3: Markers for identification of limited SSc (lSSc);
Group 4: Markers for identification of SSc overlap syndrome (overlap syndrome; SSc-OS) and
Group 5: additional markers which are not assigned to any specific group.

| SEQ ID No. | Gene ID | Gene Symbol | Gene Name | Group | p < 0.05 and fold-change > 1.5 in group |
|---|---|---|---|---|---|
| 231 | 134728 | IRAK1BP1 | interleukin-1 receptor-associated kinase 1 binding protein 1 | 4 | SSc-OS |
| 232 | 3735 | KARS | lysyl-tRNA synthetase | 4 | SSc-OS |
| 233 | 8645 | KCNK5 | potassium channel, subfamily K, member 5 | 4 | SSc-OS |
| 234 | 91012 | LASS5 | LAG1 homolog, ceramide synthase 5 | 4 | SSc-OS |
| 235 | 3991 | LIPE | lipase, hormone-sensitive | 4 | SSc-OS |
| 236 | 100129119 | LOC100129119 | hypothetical LOC100129119 | 4 | SSc-OS |
| 237 | 643733 | L00643733 | hypothetical LOC643733 | 4 | SSc-OS |
| 238 | 26065 | LSM14A | LSM14A, SCD6 homolog A (S. cerevisiae) | 4 | SSc-OS |
| 239 | 149986 | LSM14B | LSM14B, SCD6 homolog B (S. cerevisiae) | 4 | SSc-OS |
| 240 | 51599 | LSR | lipolysis stimulated lipoprotein receptor | 4 | SSc-OS |
| 241 | 51631 | LUC7L2 | LUC7-like 2 (S. cerevisiae) | 4 | SSc-OS |
| 242 | 4128 | MAOA | monoamine oxidase A | 4 | SSc-OS |
| 243 | 23542 | MAPK8IP2 | mitogen-activated protein kinase 8 interacting protein 2 | 4 | SSc-OS |
| 244 | 53615 | MBD3 | methyl-CpG binding domain protein 3 | 4 | SSc-OS |
| 245 | 124995 | MRPL10 | mitochondrial ribosomal protein L10 | 4 | SSc-OS |
| 246 | 65003 | MRPL11 | mitochondrial ribosomal protein L11 | 4 | SSc-OS |
| 247 | 4478 | MSN | moesin | 4 | SSc-OS |
| 248 | 83463 | MXD3 | MAX dimerization protein 3 | 4 | SSc-OS |
| 249 | 4601 | MXI1 | MAX interactor 1 | 4 | SSc-OS |
| 250 | 4780 | NFE2L2 | nuclear factor (erythroid-derived 2)-like 2 | 4 | SSc-OS |
| 251 | 57224 | NHSL1 | NHS-like 1 | 4 | SSc-OS |
| 252 | 4826 | NNAT | neuronatin | 4 | SSc-OS |
| 253 | 29959 | NRBP1 | nuclear receptor binding protein 1 | 4 | SSc-OS |
| 254 | 129401 | NUP35 | nucleoporin 35 kDa | 4 | SSc-OS |
| 255 | 23594 | ORC6L | origin recognition complex, subunit 6 like (yeast) | 4 | SSc-OS |
| 256 | 55229 | PANK4 | pantothenate kinase 4 | 4 | SSc-OS |
| 257 | 57326 | PBXIP1 | pre-B-cell leukemia homeobox interacting protein 1 | 4 | SSc-OS |
| 258 | 57060 | PCBP4 | poly(rC) binding protein 4 | 4 | SSc-OS |
| 259 | 94274 | PPP1R14A | protein phosphatase 1, regulatory (inhibitor) subunit 14A | 4 | SSc-OS |
| 260 | 56978 | PRDM8 | PR domain containing 8 | 4 | SSc-OS |
| 261 | 5764 | PTN | pleiotrophin | 4 | SSc-OS |

TABLE 2-continued

Summary of the (auto)antigens identified in SSc (also referred to as "markers" or "biomarkers")
What is specified is the sequential sequence ID, the gene ID, gene symbol, and the gene name. The group denotes the use of the biomarker for the identification of all SSc patients or specific SSc subgroups on the basis of a statistical threshold value of p < 0.05 and relatively higher reactivity (fold-change) compared to the control group of greater than 1.5.
Group 1: Markers for identification of all SSc patients regardless of the clinical subform;
Group 2: Markers for identification of diffuse SSc (dSSc);
Group 3: Markers for identification of limited SSc (lSSc);
Group 4: Markers for identification of SSc overlap syndrome (overlap syndrome; SSc-OS) and
Group 5: additional markers which are not assigned to any specific group.

| SEQ ID No. | Gene ID | Gene Symbol | Gene Name | Group | p < 0.05 and fold-change > 1.5 in group |
|---|---|---|---|---|---|
| 262 | 6175 | RPLP0 | ribosomal protein, large, P0 | 4 | SSc-OS |
| 263 | 6188 | RPS3 | ribosomal protein S3 | 4 | SSc-OS |
| 264 | 950 | SCARB2 | scavenger receptor class B, member 2 | 4 | SSc-OS |
| 265 | 10806 | SDCCAG8 | serologically defined colon cancer antigen 8 | 4 | SSc-OS |
| 266 | 56948 | SDR39U1 | short chain dehydrogenase/reductase family 39U, member 1 | 4 | SSc-OS |
| 267 | 10993 | SDS | serine dehydratase | 4 | SSc-OS |
| 268 | 22872 | SEC31A | SEC31 homolog A (S. cerevisiae) | 4 | SSc-OS |
| 269 | 866 | SERPINA6 | serpin peptidase inhibitor, clade A (alpha-1 antiproteinase, antitrypsin), member 6 | 4 | SSc-OS |
| 270 | 30011 | SH3KBP1 | SH3-domain kinase binding protein 1 | 4 | SSc-OS |
| 271 | 4086 | SMAD1 | SMAD family member 1 | 4 | SSc-OS |
| 272 | 79856 | SNX22 | sorting nexin 22 | 4 | SSc-OS |
| 273 | 9580 | SOX13 | SRY (sex determining region Y)-box 13 | 4 | SSc-OS |
| 274 | 6730 | SRP68 | signal recognition particle 68 kDa | 4 | SSc-OS |
| 275 | 140597 | TCEAL2 | transcription elongation factor A (SII)-like 2 | 4 | SSc-OS |
| 276 | 6924 | TCEB3 | transcription elongation factor B (SIII), polypeptide 3 (110 kDa, elongin A) | 4 | SSc-OS |
| 277 | 10915 | TCERG1 | transcription elongation regulator 1 | 4 | SSc-OS |
| 278 | 6949 | TCOF1 | Treacher Collins-Franceschetti syndrome 1 | 4 | SSc-OS |
| 279 | 26517 | TIMM13 | translocase of inner mitochondrial membrane 13 homolog (yeast) | 4 | SSc-OS |
| 280 | 22906 | TRAK1 | trafficking protein, kinesin binding 1 | 4 | SSc-OS |
| 281 | 10107 | TRIM10 | tripartite motif-containing 10 | 4 | SSc-OS |
| 282 | 81844 | TRIM56 | tripartite motif-containing 56 | 4 | SSc-OS |
| 283 | 92181 | UBTD2 | ubiquitin domain containing 2 | 4 | SSc-OS |
| 284 | 54576 | UGT1A8 | UDP glucuronosyltransferase 1 family, polypeptide A8 | 4 | SSc-OS |
| 285 | 23074 | UHRF1BP1L | UHRF1 binding protein 1-like | 4 | SSc-OS |
| 286 | 55031 | USP47 | ubiquitin specific peptidase 47 | 4 | SSc-OS |

TABLE 2-continued

Summary of the (auto)antigens identified in SSc (also referred to as "markers" or "biomarkers")
What is specified is the sequential sequence ID, the gene ID, gene symbol, and the gene name. The group denotes the use of the biomarker for the identification of all SSc patients or specific SSc subgroups on the basis of a statistical threshold value of p < 0.05 and relatively higher reactivity (fold-change) compared to the control group of greater than 1.5.
Group 1: Markers for identification of all SSc patients regardless of the clinical subform;
Group 2: Markers for identification of diffuse SSc (dSSc);
Group 3: Markers for identification of limited SSc (lSSc);
Group 4: Markers for identification of SSc overlap syndrome (overlap syndrome; SSc-OS) and
Group 5: additional markers which are not assigned to any specific group.

| SEQ ID No. | Gene ID | Gene Symbol | Gene Name | Group | p < 0.05 and fold-change > 1.5 in group |
|---|---|---|---|---|---|
| 287 | 10493 | VAT1 | vesicle amine transport protein 1 homolog (T. californica) | 4 | SSc-OS |
| 288 | 22911 | WDR47 | WD repeat domain 47 | 4 | SSc-OS |
| 289 | 23613 | ZMYND8 | zinc finger, MYND-type containing 8 | 4 | SSc-OS |
| 290 | 170959 | ZNF431 | zinc finger protein 431 | 4 | SSc-OS |
| 291 | 147837 | ZNF563 | zinc finger protein 563 | 4 | SSc-OS |
| 292 | 4747 | NEFL | neurofilament, light polypeptide | 5 | lSSc; SSc-OS; dSSc; |
| 293 | 3925 | STMN1 | stathmin 1 | 5 | lSSc; SSc-OS; dSSC |
| 294 | 1039 | CDR2 | cerebellar degeneration-related protein 2, 62 kDa | 5 | lSSc; SSc-OS |
| 295 | 5504 | PPP1R2 | protein phosphatase 1, regulatory (inhibitor) subunit 2 | 5 | lSSc; SSc-OS |
| 296 | 55131 | RBM28 | RNA binding motif protein 28 | 5 | lSSc; SSc-OS |
| 297 | 6749 | SSRP1 | structure specific recognition protein 1 | 5 | lSSc; SSc-OS |
| 298 | 54969 | C4orf27 | chromosome 4 open reading frame 27 | 5 | dSSc; lSSc |
| 299 | 784 | CACNB3 | calcium channel, voltage-dependent, beta 3 subunit | 5 | dSSc; lSSc |
| 300 | 842 | CASP9 | caspase 9, apoptosis-related cysteine peptidase | 5 | dSSc; lSSc |
| 301 | 1105 | CHD1 | chromodomain helicase DNA binding protein 1 | 5 | dSSc; lSSc |
| 302 | 1687 | DFNA5 | deafness, autosomal dominant 5 | 5 | dSSc; lSSc |
| 303 | 2237 | FEN1 | flap structure-specific endonuclease 1 | 5 | dSSc; lSSc |
| 304 | 2961 | GTF2E2 | general transcription factor IIE, polypeptide 2, beta 34 kDa | 5 | dSSc; lSSc |
| 305 | 4313 | MMP2 | matrix metallopeptidase 2 (gelatinase A, 72 kDa gelatinase, 72 kDa type IV collagenase) | 5 | dSSc; lSSc |
| 306 | 64976 | MRPL40 | mitochondrial ribosomal protein L40 | 5 | dSSc; lSSc |
| 307 | 8775 | NAPA | N-ethylmaleimide-sensitive factor attachment protein, alpha | 5 | dSSc; lSSc |
| 308 | 100137049 | PLA2G4B | phospholipase A2, group IVB (cytosolic) | 5 | dSSc; lSSc |
| 309 | 5515 | PPP2CA | protein phosphatase 2 (formerly 2A), catalytic subunit, alpha isoform | 5 | dSSc; lSSc |
| 310 | 5819 | PVRL2 | poliovirus receptor-related 2 (herpesvirus entry mediator B) | 5 | dSSc; lSSc |

TABLE 2-continued

Summary of the (auto)antigens identified in SSc (also referred to as "markers" or "biomarkers")
What is specified is the sequential sequence ID, the gene ID, gene symbol, and the gene name. The group denotes the use of the biomarker for the identification of all SSc patients or specific SSc subgroups on the basis of a statistical threshold value of p < 0.05 and relatively higher reactivity (fold-change) compared to the control group of greater than 1.5.
Group 1: Markers for identification of all SSc patients regardless of the clinical subform;
Group 2: Markers for identification of diffuse SSc (dSSc);
Group 3: Markers for identification of limited SSc (lSSc);
Group 4: Markers for identification of SSc overlap syndrome (overlap syndrome; SSc-OS) and
Group 5: additional markers which are not assigned to any specific group.

| SEQ ID No. | Gene ID | Gene Symbol | Gene Name | Group | p < 0.05 and fold-change > 1.5 in group |
|---|---|---|---|---|---|
| 311 | 9400 | RECQL5 | RecQ protein-like 5 | 5 | dSSc; lSSc |
| 312 | 11124 | FAF1 | Fas (TNFRSF6) associated factor 1 | 5 | SSc-OS; dSSc |
| 313 | 54521 | WDR44 | WD repeat domain 44 | 5 | dSSc; SSc-OS |
| 314 | 7150 | TOP1 | TOP1 | 1 | SSc |
| 315 | 23135 | KDM6B | KDM6B | 1 | SSc; dSSc; SSc-OS; |
| 316 | 55695 | NSUN5 | NSUN5 | 1 | SSc; lSSc |
| 317 | 7644 | ZNF91 | ZNF91 | 2 | dSSc |
| 318 | / | / | PGSScAg318 | 1 | SSc |
| 319 | 7 | / | PGSScAg319 | 1 | SSc |

FIG. 3 shows the autoantibody reactivity of SSc patients compared to healthy donors and SLE patients. What is illustrated is what is known as a heatmap of the logarithmised MFI values, wherein the signal height has been reproduced in a black/white scale.

Following univariate statistical evaluation, a threshold value of p<0.05 and a reactivity modified 1.5 times compared with the control group were applied.

Group 1 comprises antigens which in the group of all SSc patients fall short of a threshold value of p<0.05 compared to healthy controls and/or other rheumatic diseases and achieve a reactivity modified by 1.5 times compared to the control group: KDM6B, NSUN5, RTEL1, MYST2, TRIM21, ABCB8, AVEN, VEGFB, C19orf60, CENPA, CENPC1, CENPT, CHRM3, GORASP1, GYS1, HDAC5, ILKAP, LSM1, MARVELD2, NFIX, OSBP2, PIM3, PLXNB1, PMF1, PPIE, PRDM16, TTLL3, USP48, AZGP1, AZGP1, ZYX.

Table 3 summarises the results of the statistical tests for 36 antigens from Table 2 which have a p-value of <0.05 compared to healthy samples.

What are specified are the p-value, the increase in reactivity compared to the control group (Fold-Change), the area under the curve (AUC), and the confidence interval (CI), and also sensitivity (Sens.) and specificity (Spec.).

| Gene ID | Gene Symbol | Test | p-value | Fold-change | AUC | AUC CI | Sens. | Sens. CI | Spec. | Spec CI |
|---|---|---|---|---|---|---|---|---|---|---|
| 23135 | KDM6B | SSc vs HV | 3.43E−13 | 2.88 | 0.74 | 0.65-0.84 | 0.63 | 0.52-0.75 | 0.76 | 0.71-0.79 |
| 23135 | KDM6B | SSc vs AID | 5.30E−09 | 2.23 | 0.68 | 0.62-0.74 | 0.59 | 0.49-0.7 | 0.70 | 0.66-0.74 |
| 1060 | CENPC1 | SSc vs HV | 8.68E−12 | 2.18 | 0.74 | 0.66-0.83 | 0.53 | 0.41-0.64 | 0.85 | 0.81-0.88 |
| 1060 | CENPC1 | SSc vs AID | 3.21E−13 | 2.15 | 0.71 | 0.63-0.8 | 0.49 | 0.36-0.62 | 0.85 | 0.82-0.87 |
| 6737 | TRIM21 | SSc vs HV | 1.13E−14 | 3.04 | 0.74 | 0.66-0.83 | 0.59 | 0.48-0.69 | 0.76 | 0.72-0.79 |
| 6737 | TRIM21 | SSc vs AID | 4.44E−09 | 2.34 | 0.68 | 0.61-0.75 | 0.54 | 0.41-0.67 | 0.72 | 0.66-0.77 |
| 55695 | NSUN5 | SSc vs HV | 2.23E−08 | 1.57 | 0.70 | 0.63-0.78 | 0.53 | 0.44-0.62 | 0.81 | 0.77-0.85 |
| 55695 | NSUN5 | SSc vs AID | 1.92E−08 | 1.53 | 0.68 | 0.62-0.74 | 0.52 | 0.4-0.63 | 0.82 | 0.79-0.86 |
| 2997 | GYS1 | SSc vs HV | 3.21E−08 | 1.76 | 0.69 | 0.64-0.73 | 0.57 | 0.45-0.69 | 0.72 | 0.66-0.79 |
| 2997 | GYS1 | SSc vs AID | 6.14E−07 | 1.59 | 0.65 | 0.58-0.71 | 0.52 | 0.41-0.63 | 0.70 | 0.68-0.73 |
| 1058 | CENPA | SSc vs AID | 7.05E−09 | 2.20 | 0.68 | 0.63-0.73 | 0.49 | 0.43-0.56 | 0.80 | 0.77-0.83 |

-continued

| Gene ID | Gene Symbol | Test | p-value | Fold-change | AUC | AUC CI | Sens. | Sens. CI | Spec. | Spec CI |
|---|---|---|---|---|---|---|---|---|---|---|
| 1058 | CENPA | SSc vs HV | 9.47E−08 | 2.13 | 0.69 | 0.63-0.75 | 0.50 | 0.37-0.63 | 0.81 | 0.75-0.87 |
| 11194 | ABCB8 | SSc vs AID | 9.59E−06 | 1.42 | 0.63 | 0.56-0.71 | 0.46 | 0.35-0.58 | 0.76 | 0.71-0.81 |
| 11194 | ABCB8 | SSc vs HV | 9.54E−06 | 1.54 | 0.64 | 0.57-0.71 | 0.46 | 0.32-0.6 | 0.77 | 0.72-0.82 |
| 51750 | RTEL1 | SSc vs HV | 2.45E−05 | 2.55 | 0.64 | 0.57-0.71 | 0.53 | 0.43-0.63 | 0.67 | 0.61-0.73 |
| 51750 | RTEL1 | SSc vs AID | 1.28E−05 | 2.47 | 0.62 | 0.57-0.68 | 0.52 | 0.41-0.63 | 0.67 | 0.63-0.71 |
| 7423 | VEGFB | SSc vs HV | 1.95E−04 | 2.41 | 0.63 | 0.55-0.7 | 0.53 | 0.43-0.64 | 0.65 | 0.58-0.73 |
| 7423 | VEGFB | SSc vs AID | 5.04E−03 | 2.23 | 0.59 | 0.51-0.66 | 0.53 | 0.43-0.63 | 0.63 | 0.58-0.67 |
| 11243 | PMF1 | SSc vs HV | 1.33E−04 | 2.51 | 0.61 | 0.52-0.7 | 0.53 | 0.41-0.65 | 0.68 | 0.6-0.75 |
| 11243 | PMF1 | SSc vs AID | 6.62E−05 | 2.51 | 0.62 | 0.53-0.7 | 0.54 | 0.42-0.67 | 0.66 | 0.63-0.7 |
| 57099 | AVEN | SSc vs AID | 1.85E−04 | 2.09 | 0.62 | 0.57-0.66 | 0.55 | 0.48-0.62 | 0.64 | 0.6-0.67 |
| 57099 | AVEN | SSc vs HV | 4.48E−03 | 1.71 | 0.60 | 0.54-0.67 | 0.54 | 0.42-0.65 | 0.61 | 0.54-0.67 |
| 1131 | CHRM3 | SSc vs AID | 6.46E−03 | 1.41 | 0.58 | 0.51-0.64 | 0.51 | 0.4-0.63 | 0.64 | 0.6-0.68 |
| 1131 | CHRM3 | SSc vs HV | 1.64E−03 | 1.56 | 0.60 | 0.53-0.67 | 0.53 | 0.37-0.68 | 0.66 | 0.58-0.74 |
| 4784 | NFIX | SSc vs HV | 1.47E−03 | 1.51 | 0.60 | 0.52-0.68 | 0.48 | 0.37-0.59 | 0.67 | 0.6-0.74 |
| 4784 | NFIX | SSc vs AID | 3.88E−02 | 1.30 | 0.55 | 0.46-0.64 | 0.44 | 0.28-0.59 | 0.64 | 0.61-0.67 |
| 84196 | USP48 | SSc vs HV | 4.11E−03 | 1.60 | 0.60 | 0.54-0.65 | 0.52 | 0.42-0.63 | 0.63 | 0.58-0.69 |
| 84196 | USP48 | SSc vs AID | 2.15E−01 | 1.21 | 0.53 | 0.46-0.6 | 0.45 | 0.36-0.54 | 0.57 | 0.52-0.62 |
| 11143 | MYST2 | SSc vs HV | 4.21E−03 | 1.68 | 0.60 | 0.52-0.67 | 0.43 | 0.34-0.52 | 0.67 | 0.61-0.74 |
| 11143 | MYST2 | SSc vs AID | 2.75E−03 | 1.76 | 0.59 | 0.55-0.64 | 0.44 | 0.34-0.54 | 0.66 | 0.64-0.69 |
| 5364 | PLXNB1 | SSc vs AID | 6.60E−05 | 1.88 | 0.62 | 0.52-0.72 | 0.53 | 0.36-0.71 | 0.67 | 0.63-0.7 |
| 5364 | PLXNB1 | SSc vs HV | 6.04E−03 | 1.67 | 0.59 | 0.53-0.66 | 0.52 | 0.45-0.6 | 0.65 | 0.59-0.71 |
| 10450 | PPIE | SSc vs HV | 1.96E−03 | 1.64 | 0.59 | 0.52-0.67 | 0.49 | 0.37-0.6 | 0.69 | 0.66-0.72 |
| 10450 | PPIE | SSc vs AID | 9.14E−02 | 1.33 | 0.56 | 0.48-0.64 | 0.45 | 0.35-0.55 | 0.63 | 0.59-0.68 |
| 80152 | CENPT | SSc vs AID | 5.10E−03 | 1.60 | 0.59 | 0.53-0.64 | 0.48 | 0.34-0.62 | 0.67 | 0.63-0.72 |
| 80152 | CENPT | SSc vs HV | 8.21E−03 | 1.57 | 0.59 | 0.51-0.67 | 0.49 | 0.35-0.63 | 0.65 | 0.61-0.69 |
| 64689 | GORASP1 | SSc vs AID | 5.03E−01 | 1.03 | 0.53 | 0.46-0.59 | 0.44 | 0.33-0.55 | 0.59 | 0.55-0.63 |
| 64689 | GORASP1 | SSc vs HV | 1.37E−02 | 1.55 | 0.58 | 0.52-0.65 | 0.47 | 0.37-0.57 | 0.64 | 0.59-0.69 |
| 27257 | LSM1 | SSc vs AID | 1.58E−04 | 1.58 | 0.61 | 0.56-0.66 | 0.59 | 0.5-0.67 | 0.61 | 0.58-0.65 |
| 27257 | LSM1 | SSc vs HV | 1.46E−02 | 1.39 | 0.58 | 0.52-0.63 | 0.51 | 0.38-0.64 | 0.62 | 0.56-0.67 |
| 153562 | MARVELD2 | SSc vs AID | 1.82E−02 | 1.56 | 0.56 | 0.49-0.64 | 0.56 | 0.45-0.68 | 0.60 | 0.57-0.63 |
| 153562 | MARVELD2 | SSc vs HV | 1.39E−02 | 1.61 | 0.57 | 0.51-0.64 | 0.57 | 0.44-0.7 | 0.62 | 0.56-0.67 |
| 415116 | PIM3 | SSc vs AID | 9.59E−02 | 1.53 | 0.56 | 0.52-0.6 | 0.41 | 0.36-0.46 | 0.66 | 0.63-0.7 |
| 415116 | PIM3 | SSc vs HV | 2.65E−02 | 1.68 | 0.57 | 0.5-0.65 | 0.42 | 0.31-0.53 | 0.68 | 0.61-0.76 |
| 23762 | OSBP2 | SSc vs AID | 4.13E−03 | 1.52 | 0.59 | 0.51-0.67 | 0.49 | 0.39-0.6 | 0.67 | 0.64-0.7 |
| 23762 | OSBP2 | SSc vs HV | 5.45E−03 | 1.57 | 0.57 | 0.46-0.68 | 0.43 | 0.25-0.62 | 0.65 | 0.57-0.73 |
| 26140 | TTLL3 | SSc vs HV | 1.16E−02 | 1.50 | 0.57 | 0.46-0.68 | 0.48 | 0.32-0.64 | 0.64 | 0.58-0.71 |
| 26140 | TTLL3 | SSc vs AID | 1.14E−01 | 1.35 | 0.55 | 0.49-0.61 | 0.47 | 0.39-0.55 | 0.63 | 0.6-0.66 |
| 10014 | HDAC5 | SSc vs AID | 1.36E−01 | 1.94 | 0.55 | 0.51-0.59 | 0.53 | 0.46-0.6 | 0.50 | 0.46-0.55 |

-continued

| Gene ID | Gene Symbol | Test | p-value | Fold-change | AUC | AUC CI | Sens. | Sens. CI | Spec. | Spec CI |
|---|---|---|---|---|---|---|---|---|---|---|
| 10014 | HDAC5 | SSc vs HV | 4.32E−02 | 3.15 | 0.57 | 0.51-0.62 | 0.55 | 0.43-0.67 | 0.54 | 0.46-0.63 |
| 7791 | ZYX | SSc vs HV | 1.75E−02 | 1.54 | 0.57 | 0.49-0.64 | 0.50 | 0.35-0.64 | 0.58 | 0.52-0.64 |
| 7791 | ZYX | SSc vs AID | 2.79E−01 | 1.23 | 0.53 | 0.48-0.58 | 0.51 | 0.38-0.63 | 0.56 | 0.52-0.6 |
| 563 | AZGP1 | SSc vs AID | 1.04E−02 | 1.55 | 0.57 | 0.51-0.63 | 0.46 | 0.37-0.55 | 0.62 | 0.58-0.65 |
| 563 | AZGP1 | SSc vs HV | 3.62E−02 | 1.72 | 0.57 | 0.48-0.65 | 0.45 | 0.29-0.6 | 0.62 | 0.58-0.66 |
| 63976 | PRDM16 | SSc vs AID | 1.09E−01 | 1.35 | 0.54 | 0.42-0.65 | 0.47 | 0.27-0.68 | 0.60 | 0.56-0.63 |
| 63976 | PRDM16 | SSc vs HV | 4.52E−02 | 1.56 | 0.54 | 0.47-0.61 | 0.46 | 0.34-0.59 | 0.61 | 0.56-0.65 |
| 80895 | ILKAP | SSc vs AID | 6.86E−04 | 1.53 | 0.60 | 0.52-0.69 | 0.52 | 0.43-0.61 | 0.69 | 0.66-0.73 |
| 80895 | ILKAP | SSc vs HV | 1.52E−01 | 1.31 | 0.54 | 0.44-0.63 | 0.47 | 0.32-0.62 | 0.66 | 0.62-0.7 |
| 55049 | C19orf60 | SSc vs AID | 6.48E−03 | 1.56 | 0.58 | 0.53-0.64 | 0.60 | 0.5-0.7 | 0.57 | 0.54-0.6 |
| 55049 | C19orf60 | SSc vs HV | 3.59E−01 | 1.39 | 0.49 | 0.41-0.57 | 0.51 | 0.37-0.65 | 0.54 | 0.48-0.6 |
| 23299 | BICD2 | SSc vs HV | 1.79E−03 | 1.45 | 0.59 | 0.53 | 0.66 | 0.53-0.66 | 0.44 | 0.37 |
| 23299 | BICD2 | SSc vs AID | 1.02E−02 | 1.28 | 0.57 | 0.49 | 0.65 | 0.49-0.65 | 0.43 | 0.34 |
| 1059 | CENPB | SSc vs HV | 9.17E−08 | 1.37 | 0.69 | 0.62 | 0.75 | 0.62-0.75 | 0.46 | 0.34 |
| 1059 | CENPB | SSc vs AID | 1.04E−08 | 1.35 | 0.67 | 0.6 | 0.74 | 0.6-0.74 | 0.46 | 0.36 |
| 10290 | SPEG | SSc vs HV | 2.68E−04 | 1.31 | 0.61 | 0.55 | 0.68 | 0.55-0.68 | 0.47 | 0.36 |
| 10290 | SPEG | SSc vs AID | 8.12E−05 | 1.42 | 0.62 | 0.53 | 0.72 | 0.53-0.72 | 0.51 | 0.35 |
| 6749 | SSRP1 | SSc vs HV | 6.26E−04 | 1.36 | 0.61 | 0.52 | 0.71 | 0.52-0.71 | 0.49 | 0.40 |
| 6749 | SSRP1 | SSc vs AID | 6.16E−04 | 1.31 | 0.60 | 0.55 | 0.65 | 0.55-0.65 | 0.48 | 0.40 |
| 29968 | PSAT1 | SSc vs HV | 1.83E−02 | 1.10 | 0.58 | 0.52 | 0.63 | 0.52-0.63 | 0.37 | 0.24 |
| 29968 | PSAT1 | SSc vs AID | 7.17E−02 | 1.06 | 0.57 | 0.47 | 0.67 | 0.47-0.67 | 0.39 | 0.23 |
| 51368 | TEX264 | SSc vs HV | 1.49E−02 | 1.42 | 0.57 | 0.51 | 0.64 | 0.51-0.64 | 0.42 | 0.33 |
| 51368 | TEX264 | SSc vs AID | 3.16E−01 | 1.18 | 0.54 | 0.47 | 0.60 | 0.47-0.6 | 0.40 | 0.29 |

In order to analyse the frequency of the newly identified antigens from Table 3 in comparison with known antigens, a threshold value of 3 standard deviations (SD) above the mean value of the healthy samples was defined.

Astonishingly, at least 6 additional antigens were identified of which the frequency under consideration of all SSc patients is greater than or equal to 10%. These are KDM6B, (21%), BICD2 (19%), RTEL1 (14%), NSUN5 (13%), SSRP1 (10%) and SPEG (10%). In addition, two further antigens with a frequency greater than or equal to 5% in SSc were found: VEGFB (9%) and PSAT1 (7%).

FIG. 4 shows the frequency of 8 new antigens in SSc patients compared to anti-centromere antibodies.

Example 7: Identification of Autoantibody Reactivities in Patients With Diffuse Subform Only approximately 62.5% of the analysed patients with limited form have anti-Sc170 antibodies. A further 12.5% of patients showed anti-centromere antibodies. In order to identify further autoantibodies in patients with limited SSc, the serum samples of patients with diffuse SSc were compared with various control groups. These consisted of patients with limited SSc and patients with overlap syndrome. Autoantibodies which in the group of SSc patients with diffuse form have a p-value of less than 0.05 and a fold-change greater than 1.5 were selected. The result of the statistical tests is summarised in Table 2.

Group 2 comprises 72 additional antigens which are suitable for the identification of patients with diffuse SSc.

Group 2 antigen gene symbols: PSAT1, TEX264, ABCF3, ACAT2, TCEAL4, ACTN4, ACTR5, ALDH1A1, ALPK1, APBA2, ARHGEF16, ASMTL, ATP13A2, C11orf30, C11orf60, C17orf48, C19orf52, C20orf43, CDK5RAP2, CMPK1, CORO2B, COX5A, CTBP2, CYP4F2, DENND4B, DHRS4, DTNBP1, EEF1D, EIF2B3, EPS8L2, FEZ1, FOXL1, FUCA2, GAL3ST4, GEMIN8, GLOD4, GSN, HMGCS1, HSP90AA1, INPP5B, IRAK1, ISCU, LARS, LTF, MGEA5, MPND, MSH3, NCSTN, NEU1, P4HB, PERI, PEX14, PGCP, PPL, PRKAR1B, PTPN5, RAB11B, RAB11FIP4, RUNDC3A, STMN3, STMN4, STXBP3, SYCE1, TBCD, TMF1, TSFM, TXNRD1, UBE2Q1, UBE2Q2, UBE2Z, YTHDF1, ZNF217.

FIG. 5 shows the volcano plot of the autoantibody reactivities of SSc patients with diffuse subform compared to healthy controls.

FIG. 6 shows the frequency of the autoantibodies in the diffuse form compared to the limited form.

Patients with diffuse SSc more often have antibodies for the antigens PSAT1 (12.5%), VEGFB (12.5%), CMPK1 (9.4%), TEX264 (9.4%), WDR44 (9.4%), PPL (6.3%) and MYST2 (6.3%).

Table 4 summarises the results of the statistical tests for selected antigens of group 1 and 2. These antigens are suitable for identification and distinction of the limited and diffuse SSc subgroups.

TABLE 4

Summary of the p-values, AUC and fold-change reactivity of the antigens in the limited and diffuse SSc subgroups.

| Gene ID | Gene Symbol | Test | p-value | Fold-change | AUC | Sensitivity | Specificity |
|---|---|---|---|---|---|---|---|
| 57099 | AVEN | Diffuse vs HV | 6.04E−01 | −1.46 | 0.44 | 0.48 | 0.56 |
| 57099 | AVEN | Limited vs HV | 1.74E−06 | 4.00 | 0.70 | 0.63 | 0.67 |
| 23299 | BICD2 | Diffuse vs HV | 7.98E−01 | 1.05 | 0.45 | 0.30 | 0.56 |
| 23299 | BICD2 | Limited vs HV | 2.53E−05 | 2.10 | 0.71 | 0.59 | 0.71 |
| 1058 | CENPA | Diffuse vs HV | 3.21E−01 | 1.26 | 0.55 | 0.35 | 0.70 |
| 1058 | CENPA | Limited vs HV | 9.49E−11 | 31.39 | 0.79 | 0.70 | 0.85 |
| 1059 | CENPB | Diffuse vs HV | 8.87E−01 | −1.05 | 0.50 | 0.36 | 0.63 |
| 1059 | CENPB | Limited vs HV | 7.69E−12 | 28.22 | 0.82 | 0.72 | 0.91 |
| 1060 | CENPC1 | Diffuse vs HV | 2.96E−02 | 1.51 | 0.63 | 0.45 | 0.77 |
| 1060 | CENPC1 | Limited vs HV | 7.42E−16 | 12.12 | 0.84 | 0.63 | 0.90 |
| 51727 | CMPK1 | Diffuse vs HV | 1.14E−01 | 1.73 | 0.60 | 0.55 | 0.60 |
| 51727 | CMPK1 | Limited vs HV | 5.98E−02 | −1.51 | 0.60 | 0.64 | 0.48 |
| 23135 | KDM6B | Diffuse vs HV | 2.82E−03 | 2.06 | 0.65 | 0.63 | 0.67 |
| 23135 | KDM6B | Limited vs HV | 1.82E−14 | 7.15 | 0.84 | 0.70 | 0.82 |
| 11143 | MYST2 | Diffuse vs HV | 3.44E−03 | 3.32 | 0.65 | 0.55 | 0.71 |
| 11143 | MYST2 | Limited vs HV | 1.95E−01 | 1.33 | 0.56 | 0.45 | 0.63 |
| 4796 | NFKBIL2 | Diffuse vs HV | 1.21E−01 | 1.47 | 0.57 | 0.39 | 0.69 |
| 4796 | NFKBIL2 | Limited vs HV | 9.90E−03 | 2.42 | 0.64 | 0.56 | 0.73 |
| 55695 | NSUN5 | Diffuse vs HV | 2.02E−01 | 1.05 | 0.58 | 0.42 | 0.75 |
| 55695 | NSUN5 | Limited vs HV | 4.07E−12 | 2.69 | 0.81 | 0.71 | 0.87 |
| 55857 | PLK1S1 | Diffuse vs HV | 2.01E−01 | −1.39 | 0.55 | 0.61 | 0.55 |
| 55857 | PLK1S1 | Limited vs HV | 9.02E−03 | 1.65 | 0.60 | 0.49 | 0.61 |
| 11243 | PMF1 | Diffuse vs HV | 2.89E−02 | 2.45 | 0.64 | 0.60 | 0.67 |
| 11243 | PMF1 | Limited vs HV | 5.75E−04 | 3.29 | 0.64 | 0.55 | 0.69 |
| 5493 | PPL | Diffuse vs HV | 1.53E−03 | 2.05 | 0.65 | 0.53 | 0.68 |
| 5493 | PPL | Limited vs HV | 8.45E−02 | 1.30 | 0.58 | 0.50 | 0.64 |
| 29968 | PSAT1 | Diffuse vs HV | 2.46E−03 | 2.24 | 0.66 | 0.52 | 0.80 |
| 29968 | PSAT1 | Limited vs HV | 6.76E−01 | 1.01 | 0.52 | 0.33 | 0.75 |
| 51750 | RTEL1 | Diffuse vs HV | 3.30E−01 | −1.35 | 0.45 | 0.49 | 0.48 |
| 51750 | RTEL1 | Limited vs HV | 5.56E−10 | 5.97 | 0.78 | 0.74 | 0.75 |
| 10290 | SPEG | Diffuse vs HV | 2.46E−01 | 1.02 | 0.54 | 0.33 | 0.55 |
| 10290 | SPEG | Limited vs HV | 7.89E−04 | 2.34 | 0.69 | 0.61 | 0.62 |
| 6749 | SSRP1 | Diffuse vs HV | 2.45E−01 | −1.15 | 0.47 | 0.40 | 0.54 |
| 6749 | SSRP1 | Limited vs HV | 1.37E−05 | 2.11 | 0.71 | 0.62 | 0.73 |

TABLE 4-continued

Summary of the p-values, AUC and fold-change reactivity of the antigens in the limited and diffuse SSc subgroups.

| Gene ID | Gene Symbol | Test | p-value | Fold-change | AUC | Sensitivity | Specificity |
|---|---|---|---|---|---|---|---|
| 51368 | TEX264 | Diffuse vs HV | 1.66E−02 | 2.02 | 0.63 | 0.52 | 0.70 |
| 51368 | TEX264 | Limited vs HV | 1.12E−01 | 1.31 | 0.57 | 0.36 | 0.64 |
| 7423 | VEGFB | Diffuse vs HV | 1.77E−02 | 2.46 | 0.62 | 0.54 | 0.66 |
| 7423 | VEGFB | Limited vs HV | 8.40E−03 | 2.15 | 0.61 | 0.56 | 0.64 |
| 54521 | WDR44 | Diffuse vs HV | 5.07E−02 | 2.37 | 0.64 | 0.57 | 0.61 |
| 54521 | WDR44 | Limited vs HV | 3.00E−01 | −1.21 | 0.56 | 0.58 | 0.44 |

Example 8: Identification of Autoantibody Reactivities in Patients With Limited Subform Only approximately 60% of the analysed patients with limited form have anti-centromere antibodies. A further 18% of the patients showed anti-Sc170 antibodies. In order to identify further antibodies in patients with limited SSc, the serum samples of the patients with limited SSc were compared with different control groups. These consisted of patients with diffuse SSc and patients with overlap syndrome. Autoantibodies which in the group of SSc patients with limited form had a p-value of less than 0.05 and a fold-change of greater than 1.5 were selected. The result of the statistical tests is summarised in Table 2.

FIG. 7 shows the volcano plot of the autoantibody reactivities of patients with limited SSc compared to healthy test subjects.

Table 4 summarises the results of the statistical tests of the limited and diffuse SSc subgroups.

Group 3 comprises 69 additional antigens which are suitable for the identification of patients with limited SSc.

Group 3: antigen gene symbols:
BICD2, SPEG, ZFYVE19, AATF, ABI2, ACBD6, AIP, ANK1, ARHGDIA, AZIN1, C1orf131, C9orf16, CBX3, CCDC102A, CCNDBP1, CENPH, CORO7, DDX1, DTX4, DYNC1LI1, EIF4E, EML3, ENAH, EOMES, FAM50A, FCHSD1, GAB1, GCSH, GIPC1, GIT1, GPBP1, GTF2F1, HIST1H1A, IKBKB, ISY1, KDR, KIFAP3, MAPT, MED21, MOCOS, MRPL34, NSFL1C, PDIA6, PLK1S1, PLXNB2, RGS16, RNF4, RPL5, S100B, SET, SFPQ, SH3GL2, CENPB, SPIRE2, SPTAN1, SSB, SYF2, TAF9, TDRKH, TTC1, TTC28, TWF2, UBAP2, UNC119, WIZ, XBP1, YLPM1, ZCCHC17, ZCCHC9

FIG. 8 shows the frequency of the autoantibodies in the diffuse form compared to the limited form.

Besides anti-centromere and anti-Ro52 (TRIM21) antibodies, antibodies against the antigens KDM6B (38%), BICD2 (26%), RTEL1 (22%), NSUN5 (20%), SSRP1 (14%), AVEN (12%), PMF1 (10%), NFKBIL2 (10%), SPEG (10%) and PLK1S1 (10%) were found with a frequency of greater than or equal to 10% in patients with limited SSc.

Example 9: Identification of Autoantibody Reactivities in Patients With Overlap Syndrome A common progressive form of SSc is what is known as overlap syndrome. In clinical practice, the delimitation of this form with respect to other collagenoses is often difficult.

Group 4 comprises 119 antigens which are suitable for the identification of patients with overlap syndrome:

Group 4 antigen gene symbols: ACOT7, ACTR1B, ADD1, AIFM1, AK1, AKAP1, AKT1, ANAPC4, ANKRD16, ANKS6, APC, ARHGDIB, ASB6, ATP5D, ATP5H, AVPI1, B3GNTL1, BCKDHA, BRPF3, C11orf1, C11orf84, C14orf105, C20orf20, C3orf1, CASA, CALB2, CAPG, CBLC, CC2D1A, CCDC137, CCDC40, CCDC43, CDC2L2, CEP76, CNDP2, CNTROB, COIL, CRYAB, DES, DHX29, DIP2C, DR1, EID1, ERLIN1, FAM104B, FAM60A, FASN, FCGR1A, FKBP15, FKBP8, FUBP3, FXC1, GSTZ1, H2AFV, HNRNPA1, HNRPLL, HSBP1L1, HSPA8, IRAK1BP1, KARS, KCNK5, LASS5, LIPE, LOC100129119, LOC643733, LSM14A, LSM14B, LSR, LUC7L2, MAOA, MAPK8IP2, MBD3, MRPL10, MRPL11, MSN, MXD3, MXI1, NFE2L2, NHSL1, NNAT, NRBP1, NUP35, ORC6L, PANK4, PBXIP1, PCBP4, PPP1R14A, PRDM8, PTN, RPLP0, RPS3, SCARB2, SDC-CAG8, SDR39U1, SDS, SEC31A, SERPINA6, SH3KBP1, SMAD1, SNX22, SOX13, SRP68, TCEAL2, TCEB3, TCERG1, TCOF1, TIMM13, TRAK1, TRIM10, TRIM56, UBTD2, UGT1A8, UHRF1BP1L, USP47, VAT1, WDR47, ZMYND8, ZNF431, ZNF563.

Group 5 in Table 2 contains further statistically significant antigens which can be used for the diagnosis and differential diagnosis of SSc compared to healthy test subjects and other autoimmune diseases.

Group 5: antigen gene symbols: HIST1H2BA, NEFL, STMN1, STMN1, CDR2, PPP1R2, RBM28, SSRP1, C4orf27, CACNB3, CASP9, CHD1, DFNA5, FEN1, GTF2E2, MMP2, MRPL40, NAPA, PLA2G4B, PPP2CA, PVRL2, RECQLS, FAF1, WDR44.

Example 10: Application of Antigen Panels, Moreover for Improved Diagnosis of SSc On account of the clinical and serological heterogeneity of the SSc disease, it is not possible to diagnose this disease using just one biomarker. According to Mierau et al. (2011), only approximately 35.9% of SSc patients have autoantibodies against centromere proteins and only 30.1% have autoantibodies against anti-topomerase I (anti-Sc170). There is thus also a great need for specific diagnostic and prognostic markers.

In order to develop an improved diagnostic antigen panel for SSc, antigens from Tables 3 and 4 were selected.

The narrower selection initially included five of the antigens represented most frequently in SSc: KDM6B, BICD2, RTEL1 and NSUN5) (FIG. 4).

In addition, the frequency of autoantibodies in diffuse SSc, which progresses particularly severely, was also taken into consideration. Here, two of the most frequent reactive antigens BICD2 (12.5) and PSAT1 (12.5) were selected.

In addition, antigens to which anti-Sc170-negative and anti-centromere-negative patients react were selected.

FIG. 9 shows the frequency of autoantibodies compared with a selection of antigens from Tables 3 and 4 in anti-centromere-negative and anti-Sc170-negative patients.

In particular, the antigens MARVELD2 (19%), MYST2 (19%), VEGFB (19%). PSAT1 (14%). NSUN5 (14%) and TEX264 (14%) have a frequency of more than 10% in anti-centromere- and anti-Sc170-negative SSc patients. These antigens are therefore particularly suitable for improving the diagnosis.

Four of the most frequently reactive antigens in doubly negative SSc patients (MYST2, PSAT1, NSUN5 and TEX264) were therefore selected for the development of an improved diagnostic test.

The final composition of the panel is illustrated in Table 5.

TABLE 5

Composition of the improved diagnostic panel.

| Gene ID | Gene Symbol | Gene Name | Panel I | Panel II |
|---|---|---|---|---|
| 1059 | CENPB | centromere protein B, 80 kDa | x | x |
| 7250 | TOP1 | topoisomerase (DNA) I | x | x |
| 23135 | KDM6B | lysine (K)-specific demethylase 6B | | x |
| 23299 | BICD2 | bicaudal D homolog 2 (*Drosophila*) | | x |
| 55695 | NSUN5 | NOL1/NOP2/Sun domain family, member 5 | | x |
| 51750 | RTEL1 | regulator of telomere elongation helicase 1 | | x |
| 11143 | MYST2 | MYST histone acetyltransferase 2 | | x |
| 29968 | PSAT1 | phosphoserine aminotransferase 1 | | x |

The first 7 antigens in Table 2 include the most important antigens used for the compilation of biomarker panels for the diagnosis of SSc: KDM6B, NSUN5, BICD2, RTEL1, MYST2, PSAT1 and TEX264

For validation of the antigens from panel I and panel II specified in table 5, 100 SSc patients and 100 healthy samples were measured using antigen-coupled Luminex beads.

The MFI values of the antigens TOP1, CENPB, KDM6B, NSUN5, BICD2, RTEL1, MYST2, PSAT1 and TEX264 were used to calculate the area under the curve (AUC), sensitivity, and specificity.

FIG. 10a shows the receiver operator curves (ROC) for a logistic regression model based on panel I consisting of anti-CENPB and anti-Sc170.

FIG. 10b shows the ROC curve for the improved panel consisting of anti-CENPB and anti-Sc170 and the five new antigens KDM6B, NSUN5, BICD2, RTEL1, MYST2, PSAT1 and TEX264.

It was possible to increase the sensitivity by 7% from 72% to 79% due to the inclusion of the 5 antigens KDM6B, NSUN5, BICD2, RTEL1, MYST2, PSAT1 and TEX264.

On the basis of the example, it is clear how the prediction quality of a biomarker model can be increased with inclusion of the additional markers so as to achieve a better classification of patients.

The inclusion of additional markers besides the known markers improves the prediction quality in the applied method significantly with approximately 7% ROC.

TABLE 6

AUC, sensitivity, and specificity of the SSc panel

| SSc vs Healthy Control | AUC | CI (AUC) | Sens. | CI (Sens.) | Spec. | CI (Spec) |
|---|---|---|---|---|---|---|
| panel I | 0.91 | [0.862, 0.965] | 0.72 | [0.621, 0.823] | 0.97 | [0.935, 1] |
| panel II | 0.94 | [0.891, 0.98] | 0.79 | [0.71, 0.868] | 0.94 | [0.88, 1] |

TABLE 7

| GeneID | Gene Symbol | RNA_nucleotide_SEQ (pbplus & manuell) |
|---|---|---|
| 23135 | KDM6B | NM_001080424.1 |
| 23299 | BICD2 | NM_001003800.1 |
| 55695 | NSUN5 | NM_001168347.2 |
| 51750 | RTEL1 | NM_016434.3 |
| 11143 | MYST2 | NM_001199155.1 |
| 29968 | PSAT1 | NM_021154.4 |
| 51368 | TEX264 | NM_001129884.2 |
| 6737 | TRIM21 | NM_003141.3 |
| 11194 | ABCB8 | NM_007188.4 |
| 57099 | AVEN | NM_020371.2 |
| 7423 | VEGFB | NM_001243733.1 |
| 55049 | C19orf60 | NM_001100418.1 |
| 1058 | CENPA | NM_001042426.1 |
| 1060 | CENPC1 | NM_001812.2 |
| 80152 | CENPT | NM_025082.3 |
| 1131 | CHRM3 | NM_000740.2 |
| 64689 | GORASP1 | NM_031899.3 |
| 2997 | GYS1 | NM_001161587.1 |
| 10014 | HDAC5 | NM_001015053.1 |
| 80895 | ILKAP | NM_030768.2 |
| 27257 | LSM1 | NM_014462.2 |
| 153562 | MARVELD2 | NM_001038603.2 |
| 4784 | NFIX | NM_002501.3 |
| 23762 | OSBP2 | NM_030758.3 |
| 415116 | PIM3 | NM_001001852.3 |
| 5364 | PLXNB1 | NM_001130082.2 |
| 11243 | PMF1 | NM_001199653.1 |
| 10450 | PPIE | NM_001195007.1 |
| 63976 | PRDM16 | NM_022114.3 |
| 26140 | TTLL3 | NM_001025930.3 |
| 84196 | USP48 | NM_001032730.1 |
| 563 | AZGP1 | NM_001185.3 |
| 7791 | ZYX | NM_001010972.1 |
| 55324 | ABCF3 | NM_018358.2 |
| 39 | ACAT2 | NM_005891.2 |
| 79921 | TCEAL4 | NM_001006935.1 |
| 81 | ACTN4 | NM_004924.4 |
| 79913 | ACTR5 | NM_024855.3 |
| 216 | ALDH1A1 | NM_000689.4 |
| 80216 | ALPK1 | NM_001102406.1 |
| 321 | APBA2 | NM_001130414.1 |
| 27237 | ARHGEF16 | NM_014448.3 |
| 8623 | ASMTL | NM_001173473.1 |
| 23400 | ATP13A2 | NM_001141973.1 |
| 56946 | C11orf30 | NM_020193.3 |
| 56912 | C11orf60 | NM_001168618.1 |

TABLE 7-continued

| GeneID | Gene Symbol | RNA_nucleotide_SEQ (pbplus & manuell) |
|---|---|---|
| 56985 | C17orf48 | NM_020233.4 |
| 90580 | C19orf52 | NM_138358.2 |
| 51507 | C20orf43 | NM_016407.4 |
| 55755 | CDK5RAP2 | NM_001011649.2 |
| 51727 | CMPK1 | NM_001136140.1 |
| 10391 | CORO2B | NM_001190456.1 |
| 9377 | COX5A | NM_004255.3 |
| 1488 | CTBP2 | NM_001083914.1 |
| 8529 | CYP4F2 | NM_001082.4 |
| 9909 | DENND4B | NM_014856.2 |
| 10901 | DHRS4 | NM_021004.3 |
| 84062 | DTNBP1 | NM_032122.4 |
| 1936 | EEF1D | NM_001130053.2 |
| 8891 | EIF2B3 | NM_001166588.2 |
| 64787 | EPS8L2 | NM_022772.3 |
| 9638 | FEZ1 | NM_005103.4 |
| 2300 | FOXL1 | NM_005250.2 |
| 2519 | FUCA2 | NM_032020.4 |
| 79690 | GAL3ST4 | NM_024637.4 |
| 54960 | GEMIN8 | NM_001042479.1 |
| 51031 | GLOD4 | NM_016080.3 |
| 2934 | GSN | NM_000177.4 |
| 3157 | HMGCS1 | NM_001098272.2 |
| 3320 | HSP90AA1 | NM_001017963.2 |
| 3633 | INPP5B | NM_005540.2 |
| 3654 | IRAK1 | NM_001025242.1 |
| 23479 | ISCU | NM_014301.3 |
| 51520 | LARS | NM_020117.9 |
| 4057 | LTF | NM_001199149.1 |
| 10724 | MGEA5 | NM_001142434.1 |
| 84954 | MPND | NM_001159846.1 |
| 4437 | MSH3 | NM_002439.4 |
| 23385 | NCSTN | NM_015331.2 |
| 4758 | NEU1 | NM_000434.3 |
| 5034 | P4HB | NM_000918.3 |
| 5187 | PER1 | NM_002616.2 |
| 5195 | PEX14 | NM_004565.2 |
| 10404 | PGCP | XM_006716498.1 |
| 5493 | PPL | NM_002705.4 |
| 5575 | PRKAR1B | NM_001164758.1 |
| 84867 | PTPN5 | NM_001039970.1 |
| 9230 | RAB11B | NM_004218.3 |
| 84440 | RAB11FIP4 | NM_032932.3 |
| 10900 | RUNDC3A | NM_001144825.1 |
| 50861 | STMN3 | NM_015894.3 |
| 81551 | STMN4 | NM_030795.3 |
| 6814 | STXBP3 | NM_007269.2 |
| 93426 | SYCE1 | NM_001143763.1 |
| 6904 | TBCD | NM_005993.4 |
| 7110 | TMF1 | NM_007114.2 |
| 10102 | TSFM | NM_001172695.1 |
| 7296 | TXNRD1 | NM_001093771.2 |
| 55585 | UBE2Q1 | NM_017582.6 |
| 92912 | UBE2Q2 | NM_001145335.1 |
| 65264 | UBE2Z | NM_023079.4 |
| 54915 | YTHDF1 | NM_017798.3 |
| 7764 | ZNF217 | NM_006526.2 |
| 10290 | SPEG | NM_001173476.1 |
| 84936 | ZFYVE19 | NM_001077268.1 |
| 26574 | AATF | NM_012138.3 |
| 10152 | ABI2 | NM_005759.5 |
| 84320 | ACBD6 | NM_032360.3 |
| 9049 | AIP | NM_003977.2 |
| 286 | ANK1 | NM_000037.3 |
| 396 | ARHGDIA | NM_001185077.1 |
| 51582 | AZIN1 | NM_015878.4 |
| 128061 | C1orf131 | NM_152379.2 |
| 79095 | C9orf16 | NM_024112.3 |
| 11335 | CBX3 | NM_007276.4 |
| 92922 | CCDC102A | NM_033212.3 |
| 23582 | CCNDBP1 | NM_012142.4 |
| 64946 | CENPH | NM_022909.3 |
| 79585 | CORO7 | NM_001201472.1 |
| 1653 | DDX1 | NM_004939.2 |
| 23220 | DTX4 | NM_015177.1 |
| 51143 | DYNC1LI1 | NM_016141.3 |
| 1977 | EIF4E | NM_001130678.1 |
| 256364 | EML3 | NM_153265.2 |
| 55740 | ENAH | NM_001008493.1 |
| 8320 | EOMES | NM_005442.3 |
| 9130 | FAM50A | NM_004699.3 |
| 89848 | FCHSD1 | NM_033449.2 |
| 2549 | GAB1 | NM_002039.3 |
| 2653 | GCSH | NM_004483.4 |
| 10755 | GIPC1 | NM_005716.3 |
| 28964 | GIT1 | NM_001085454.1 |
| 65056 | GPBP1 | NM_001127235.2 |
| 2962 | GTF2F1 | NM_002096.2 |
| 3024 | HIST1H1A | NM_005325.3 |
| 3551 | IKBKB | NM_001190720.2 |
| 57461 | ISY1 | NM_001199469.1 |
| 3791 | KDR | NM_002253.2 |
| 22920 | KIFAP3 | NM_001204514.1 |
| 4137 | MAPT | NM_001123066.3 |
| 9412 | MED21 | NM_004264.4 |
| 55034 | MOCOS | NM_017947.2 |
| 64981 | MRPL34 | NM_023937.3 |
| 55968 | NSFL1C | NM_001206736.1 |
| 10130 | PDIA6 | NM_005742.3 |
| 55857 | PLK1S1 | NM_001163022.1 |
| 23654 | PLXNB2 | NM_012401.3 |
| 6004 | RGS16 | NM_002928.3 |
| 6047 | RNF4 | NM_001185009.2 |
| 6125 | RPL5 | NM_000969.3 |
| 6285 | S100B | NM_006272.2 |
| 6418 | SET | NM_001122821.1 |
| 6421 | SFPQ | NM_005066.2 |
| 6456 | SH3GL2 | NM_003026.2 |
| 1059 | CENPB | NM_001810.5 |
| 84501 | SPIRE2 | NM_032451.1 |
| 6709 | SPTAN1 | NM_001130438.2 |
| 6741 | SSB | NM_003142.4 |
| 25949 | SYF2 | NM_015484.4 |
| 6880 | TAF9 | NM_001015891.1 |
| 11022 | TDRKH | NM_001083963.1 |
| 7265 | TTC1 | NM_003314.2 |
| 23331 | TTC28 | NM_001145418.1 |
| 11344 | TWF2 | NM_007284.3 |
| 55833 | UBAP2 | NM_018449.3 |
| 9094 | UNC119 | NM_005148.3 |
| 58525 | WIZ | NM_021241.2 |
| 7494 | XBP1 | NM_001079539.1 |
| 56252 | YLPM1 | NM_019589.2 |
| 51538 | ZCCHC17 | NM_016505.3 |
| 84240 | ZCCHC9 | NM_001131035.1 |
| 255626 | HIST1H2BA | NM_170610.2 |
| 11332 | ACOT7 | NM_007274.3 |
| 10120 | ACTR1B | NM_005735.3 |
| 118 | ADD1 | NM_001119.4 |
| 9131 | AIFM1 | NM_001130846.2 |
| 203 | AK1 | NM_000476.2 |
| 8165 | AKAP1 | NM_001242902.1 |
| 207 | AKT1 | NM_001014431.1 |
| 29945 | ANAPC4 | NM_013367.2 |
| 54522 | ANKRD16 | NM_001009941.2 |
| 203286 | ANKS6 | NM_173551.3 |
| 324 | APC | NM_000038.5 |
| 397 | ARHGDIB | NM_001175.5 |
| 140459 | ASB6 | NM_001202403.1 |
| 513 | ATP5D | NM_001001975.1 |
| 10476 | ATP5H | NM_001003785.1 |
| 60370 | AVPI1 | NM_021732.2 |
| 146712 | B3GNTL1 | NM_001009905.1 |
| 593 | BCKDHA | NM_000709.3 |
| 27154 | BRPF3 | NM_015695.2 |
| 64776 | C11orf1 | NM_022761.2 |
| 144097 | C11orf84 | NM_138471.1 |
| 55195 | C14orf105 | NM_018168.3 |
| 55257 | C20orf20 | NM_018270.4 |
| 51300 | C3orf1 | NM_016589.3 |
| 763 | CA5A | NM_001739.1 |
| 794 | CALB2 | NM_001740.4 |
| 822 | CAPG | NM_001256139.1 |
| 23624 | CBLC | NM_001130852.1 |

TABLE 7-continued

| GeneID | Gene Symbol | RNA_nucleotide_SEQ (pbplus & manuell) |
|---|---|---|
| 54862 | CC2D1A | NM_017721.4 |
| 339230 | CCDC137 | NM_199287.2 |
| 55036 | CCDC40 | NM_001243342.1 |
| 124808 | CCDC43 | NM_001099225.1 |
| 728642 | CDC2L2 | NM_024011.2 |
| 79959 | CEP76 | NM_024899.3 |
| 55748 | CNDP2 | NM_001168499.1 |
| 116840 | CNTROB | NM_001037144.5 |
| 8161 | COIL | NM_004645.2 |
| 1410 | CRYAB | NM_001885.2 |
| 1674 | DES | NM_001927.3 |
| 54505 | DHX29 | NM_019030.2 |
| 22982 | DIP2C | NM_014974.2 |
| 1810 | DR1 | NM_001938.2 |
| 23741 | EID1 | NM_014335.2 |
| 10613 | ERLIN1 | NM_001100626.1 |
| 90736 | FAM104B | NM_001166699.1 |
| 58516 | FAM60A | NM_001135811.1 |
| 2194 | FASN | NM_004104.4 |
| 2209 | FCGR1A | NM_000566.3 |
| 23307 | FKBP15 | NM_015258.1 |
| 23770 | FKBP8 | NM_012181.3 |
| 8939 | FUBP3 | NM_003934.1 |
| 26515 | FXC1 | NM_012192.3 |
| 2954 | GSTZ1 | NM_001513.3 |
| 94239 | H2AFV | NM_012412.4 |
| 3178 | HNRNPA1 | NM_002136.2 |
| 92906 | HNRPLL | NM_001142650.1 |
| 440498 | HSBP1L1 | NM_001136180.1 |
| 3312 | HSPA8 | NM_006597.5 |
| 134728 | IRAK1BP1 | NM_001010844.3 |
| 3735 | KARS | NM_001130089.1 |
| 8645 | KCNK5 | NM_003740.3 |
| 91012 | LASS5 | NM_147190.3 |
| 3991 | LIPE | NM_005357.3 |
| 100129119 | LOC100129119 | |
| 643733 | LOC643733 | |
| 26065 | LSM14A | NM_001114093.1 |
| 149986 | LSM14B | NM_144703.2 |
| 51599 | LSR | NM_015925.6 |
| 51631 | LUC7L2 | NM_001244584.2 |
| 4128 | MAOA | NM_000240.3 |
| 23542 | MAPK8IP2 | NM_012324.4 |
| 53615 | MBD3 | NM_003926.5 |
| 124995 | MRPL10 | NM_145255.3 |
| 65003 | MRPL11 | NM_016050.3 |
| 4478 | MSN | NM_002444.2 |
| 83463 | MXD3 | NM_001142935.1 |
| 4601 | MXI1 | NM_001008541.1 |
| 4780 | NFE2L2 | NM_001145412.2 |
| 57224 | NHSL1 | NM_001144060.1 |
| 4826 | NNAT | NM_005386.2 |
| 29959 | NRBP1 | NM_013392.2 |
| 129401 | NUP35 | NM_138285.4 |
| 23594 | ORC6L | NM_014321.3 |
| 55229 | PANK4 | NM_018216.1 |
| 57326 | PBXIP1 | NM_020524.2 |
| 57060 | PCBP4 | NM_001174100.1 |
| 94274 | PPP1R14A | NM_001243947.1 |
| 56978 | PRDM8 | NM_001099403.1 |
| 5764 | PTN | NM_002825.5 |
| 6175 | RPLP0 | NM_001002.3 |
| 6188 | RPS3 | NM_001005.4 |
| 950 | SCARB2 | NM_001204255.1 |
| 10806 | SDCCAG8 | NM_006642.3 |
| 56948 | SDR39U1 | NM_020195.2 |
| 10993 | SDS | NM_006843.2 |
| 22872 | SEC31A | NM_001077206.2 |
| 866 | SERPINA6 | NM_001756.3 |
| 30011 | SH3KBP1 | NM_001024666.2 |
| 4086 | SMAD1 | NM_001003688.1 |
| 79856 | SNX22 | NM_024798.2 |
| 9580 | SOX13 | NM_005686.2 |
| 6730 | SRP68 | NM_014230.3 |
| 140597 | TCEAL2 | NM_080390.3 |
| 6924 | TCEB3 | NM_003198.2 |
| 10915 | TCERG1 | NM_001040006.1 |

TABLE 7-continued

| GeneID | Gene Symbol | RNA_nucleotide_SEQ (pbplus & manuell) |
|---|---|---|
| 6949 | TCOF1 | NM_000356.3 |
| 26517 | TIMM13 | NM_012458.3 |
| 22906 | TRAK1 | NM_001042646.2 |
| 10107 | TRIM10 | NM_006778.3 |
| 81844 | TRIM56 | NM_030961.1 |
| 92181 | UBTD2 | NM_152277.2 |
| 54576 | UGT1A8 | NM_019076.4 |
| 23074 | UHRF1BP1L | NM_001006947.1 |
| 55031 | USP47 | NM_017944.3 |
| 10493 | VAT1 | NM_006373.3 |
| 22911 | WDR47 | NM_001142550.1 |
| 23613 | ZMYND8 | NM_012408.5 |
| 170959 | ZNF431 | NM_133473.2 |
| 147837 | ZNF563 | NM_145276.2 |
| 4747 | NEFL | NM_006158.4 |
| 3925 | STMN1 | NM_001145454.1 |
| 1039 | CDR2 | NM_001802.1 |
| 5504 | PPP1R2 | NM_006241.6 |
| 55131 | RBM28 | NM_001166135.1 |
| 6749 | SSRP1 | NM_003146.2 |
| 54969 | C4orf27 | NM_017867.2 |
| 784 | CACNB3 | NM_000725.3 |
| 842 | CASP9 | NM_001229.4 |
| 1105 | CHD1 | NM_001270.2 |
| 1687 | DFNA5 | NM_001127453.1 |
| 2237 | FEN1 | NM_004111.5 |
| 2961 | GTF2E2 | NM_002095.4 |
| 4313 | MMP2 | NM_001127891.1 |
| 64976 | MRPL40 | NM_003776.2 |
| 8775 | NAPA | NM_003827.3 |
| 100137049 | PLA2G4B | NM_001114633.1 |
| 5515 | PPP2CA | NM_002715.2 |
| 5819 | PVRL2 | NM_001042724.1 |
| 9400 | RECQL5 | NM_001003715.3 |
| 11124 | FAF1 | NM_007051.2 |
| 54521 | WDR44 | NM_001184965.1 |

Example 11: Validation of SSc-Associated Autoantibodies in an Independent Sample Collective The markers specified in table 2 were tested in a second independent sample collective (SSc cohort II). In total, 180 serum samples from SSc patients were analysed, of which the demographic and clinical data were taken from the EUSTAR database. EISTAR is a multi-centre, prospective cohort of the European League Against Rheumatism (EULAR) Scleroderma Trials and Research (EUSTAR) group. As control groups, n=99 serum samples from healthy controls and n=110 serum samples from patients with rheumatic autoimmune diseases (ADs) were used.

These were composed of serum samples from patients with a diagnosis of SLE, myositis, arthritis and Sjögren's syndrome.

TABLE 6

Demographic, clinical and serological data of the SSc cohort II.

| Number (%); mean value (%) | Total SSc (n = 180) | Main participation | |
|---|---|---|---|
| | | dSSc(n = 57) | lSSc (n = 83) |
| Female n (%) | 142 (79.9) | 42 (737) | 67 (80.7) |
| Male n (%) | 38 (21.1) | 15 (26.3) | 16 (19.3) |
| Age mean value (SD) | 56.5 (13.8) | 52.9 (12.2) | 58.2 (15.1) |

TABLE 6-continued

Demographic, clinical and serological data of the SSc cohort II.

| Number (%); mean value (%) | Total SSc SSc (n = 180) | Main participation | |
|---|---|---|---|
| | | dSSc(n = 57) | lSSc (n = 83) |
| Average duration of the disease in years (SD) | 8.2 (9.7) | 6.98 (6.8) | 9.9 (11.9) |
| ANA positive n (%) | 176 (97.8) | 55 (96.5) | 82 (98.8) |
| anti-CENPB positive n (%) | 66 (36.7) | 5 (8.8) | 34 (41) |
| anti-Sc170 positive n (%) | 50 (27.8) | 21 (36.8) | 21 (25.3) |

For this purpose, the human proteins specified in Table 2 were coupled to Luminex beads and the protein-coupled beads were measured in a multiplex assay with the patient samples. The binding of autoantibodies was measured by means of a PE-conjugated autoantibody in a Luminex instrument.

A univariate statistical evaluation was carried out using the Wilcoxon rank sum test. The predefined significance level was set at 0.05. Table 7 contains 41 antigens, which, both in SSc cohort I, which was used for discovery of the markers (Example 6), and in SSc cohort II, achieved a p-value less than the set significance level of 0.05. For the comparison of all SSc samples against healthy controls (HC), 31 markers achieved a p-value of less than 0.05. For the comparison of all SSc samples against a combined group of serum samples of various rheumatoid diseases (ADs), 24 markers achieved a p-value of less than 0.05.

TABLE 7

Summary of the p-values (Wilcoxon rank sum test) for 41 markers for the diagnosis of SSc in SSc cohort II

| Marker Nr | Gene Symbol | SSc vs HC | | | | SSc vs AD SSc |
|---|---|---|---|---|---|---|
| | | SSc | Scl70 & CENPB neg | dSSc | lSSc | |
| 1 | KDM6B | 3.09E−10 | 1.33E−03 | 6.13E−05 | 2.02E−08 | 2.25E−02 |
| 2 | BICD2 | 4.19E−03 | 6.48E−01 | 7.77E−01 | 5.11E−04 | 7.37E−01 |
| 3 | NSUN5 | 1.62E−05 | 4.06E−01 | 9.41E−01 | 4.30E−06 | 5.04E−03 |
| 4 | RTEL1 | 1.28E−03 | 3.69E−01 | 4.16E−01 | 4.32E−04 | 7.74E−02 |
| 8 | TRIM21 | 5.30E−09 | 1.51E−05 | 1.65E−06 | 5.90E−07 | 3.88E−01 |
| 9 | ABCB8 | 1.81E−03 | 8.10E−01 | 3.37E−01 | 1.13E−01 | 1.02E−02 |
| 10 | AVEN | 2.06E−03 | 7.33E−01 | 4.37E−01 | 1.83E−03 | 7.88E−02 |
| 13 | CENPA | 2.31E−04 | 3.02E−01 | 3.03E−01 | 8.03E−05 | 1.92E−03 |
| 14 | CENPC | 4.17E−11 | 5.64E−03 | 2.25E−02 | 5.14E−10 | 5.01E−07 |
| 15 | CENPT | 7.50E−02 | 4.61E−01 | 8.25E−01 | 1.05E−02 | 1.98E−02 |
| 18 | GYS1 | 1.99E−02 | 2.91E−02 | 3.40E−01 | 2.07E−02 | 8.24E−01 |
| 22 | MARVELD2 | 3.77E−02 | 1.84E−01 | 1.26E−01 | 1.71E−01 | 1.78E−02 |
| 27 | PMF1 | 4.96E−02 | 9.77E−01 | 3.39E−01 | 3.28E−01 | 3.60E−02 |
| 30 | TTLL3 | 2.01E−02 | 1.30E−01 | 9.82E−01 | 2.04E−02 | 9.67E−01 |
| 40 | ALPK1 | 1.07E−02 | 1.90E−03 | 5.15E−02 | 5.65E−02 | 7.13E−01 |
| 44 | ATP13A2 | 1.83E−02 | 7.52E−02 | 6.30E−01 | 1.61E−02 | 3.62E−01 |
| 48 | C19orf52 | 8.67E−03 | 1.70E−01 | 7.77E−01 | 3.51E−02 | 5.48E−03 |
| 75 | LTF | 7.97E−03 | 4.52E−01 | 7.16E−01 | 3.10E−03 | 9.21E−01 |
| 92 | STMN4 | 5.50E−05 | 6.47E−04 | 3.64E−03 | 7.59E−04 | 3.06E−02 |
| 108 | ACBD6 | 4.17E−03 | 3.71E−01 | 2.99E−01 | 6.41E−03 | 4.02E−02 |
| 115 | CBX3 | 2.66E−03 | 5.41E−01 | 2.33E−01 | 3.48E−02 | 4.45E−03 |
| 118 | CENPH | 2.27E−01 | 1.78E−01 | 5.44E−01 | 4.22E−02 | 2.19E−02 |
| 123 | EIF4E | 2.78E−02 | 9.74E−01 | 6.72E−01 | 1.52E−02 | 2.54E−04 |
| 134 | GTF2F1 | 1.07E−04 | 4.08E−02 | 3.28E−02 | 6.88E−05 | 2.30E−01 |
| 137 | ISY1 | 2.19E−02 | 2.06E−02 | 4.30E−02 | 1.35E−01 | 3.65E−01 |
| 138 | KDR | 3.68E−02 | 1.77E−01 | 4.65E−02 | 4.22E−01 | 3.39E−04 |
| 140 | MAPT | 2.50E−04 | 5.34E−01 | 2.76E−01 | 2.63E−05 | 4.82E−01 |
| 155 | CENPB | 4.27E−12 | 7.99E−01 | 8.41E−03 | 6.90E−11 | 2.91E−09 |
| 158 | SSB | 9.04E−02 | 1.56E−01 | 6.06E−01 | 3.07E−02 | 2.61E−01 |
| 213 | DIP2C | 2.44E−02 | 5.27E−02 | 5.08E−01 | 8.26E−03 | 1.87E−01 |
| 224 | TIMM10B | 4.05E−02 | 5.16E−03 | 3.86E−02 | 2.42E−01 | 3.51E−01 |
| 227 | HNRNPA1 | 1.48E−02 | 2.54E−02 | 1.67E−03 | 1.28E−01 | 7.77E−01 |
| 229 | HSBP1L1 | 2.45E−02 | 1.03E−01 | 1.91E−02 | 2.88E−01 | 1.05E−01 |
| 232 | KARS | 1.25E−02 | 5.71E−03 | 2.85E−02 | 1.12E−01 | 8.70E−03 |
| 257 | PBXIP1 | 6.43E−06 | 2.08E−01 | 2.49E−01 | 8.61E−05 | 3.83E−01 |
| 290 | ZNF431 | 3.94E−02 | 3.68E−02 | 1.59E−01 | 9.45E−02 | 4.67E−02 |
| 292 | NEFL | 6.97E−03 | 6.01E−02 | 9.19E−02 | 3.95E−02 | 8.50E−01 |
| 293 | STMN1 | 6.11E−05 | 6.13E−04 | 3.69E−03 | 8.75E−04 | 4.19E−03 |
| 295 | PPP1R2 | 1.19E−02 | 7.79E−01 | 3.69E−02 | 6.39E−02 | 1.98E−01 |
| 297 | SSRP1 | 4.79E−02 | 7.17E−01 | 7.91E−01 | 2.02E−02 | 4.19E−03 |
| 314 | TOP1 | 6.19E−07 | 4.23E−01 | 6.94E−05 | 4.10E−05 | 4.96E−07 |

Example 12: Application of Autoantibody Panels for the Diagnosis of SSc

From the markers contained in Table 2 and Table 7, various marker combinations were tested by means of logistic regression models. Here, the specificity compared to the control group was set to at least 95% as a requirement. An overview of the antigens used in panels 1 and 3-8 is contained in Table 8. In addition, a diagnostic panel 9 was compiled with use of all markers from Table 2. The panels 1, 3, 4, 5 and 9 are preferably suitable for the diagnosis of all SSc patients, regardless of the particular subtype. The AUC (area under the curve) of panels 1, 3, 4, 6 and 9 is specified in Table 8 for 2 independent SSc sample collectives (cohort I and cohort II).

Panel 1 consists of the antigens Sc170(Top1) and CENPB used conventionally for diagnosis and achieves an AUC of 0.81 in cohort I and 0.85 in cohort II for the comparison SSc versus healthy test subject (HC).

Panel 3 consists of two diagnostic antigens CEPNB and SC170, and two new SSc antigens KDM6B and BICD2. Compared to the usually used markers of panel 1, a logistic model for panel 3 shows a much higher AUC for the comparison SSc versus healthy test subject (HC): 0.88 for cohort I compared to 0.81, and 0.87 for cohort II compared to 0.85.

Panel 4 is based on panel 3 and contains two further new markers NSUN5 and PPP1R2. For the diagnosis of SSc compared to healthy test samples, a logistic regression model for panel 4 achieves an AUC of 0.9 for cohort I and an AUC of 0.85 for cohort II.

Panel 5 is based on panel 4 and, in addition to the diagnostic markers CENPB and Sc170, also contains the markersKDM6B, BICD2, NSUN5, PPP1R2, RTEL1, TRIM21, ABCB8, AVEN, CENPA, CENPC1, GYS1, MARVELD2, PMF1, TTLL3, ATP13A2, LTF, STMN4, ACBD6, GTF2F1, KDR, DIP2C, FXC1, HNRNPA1, HSBP1L1, KARS, PBXIP1, ZNF431, STMN1 and SSRP1.

TABLE 8

Composition of the marker panels

| | | SSc diagnosis | | | | CENPB & Sc170 neg. | dSSc | lSSc |
|---|---|---|---|---|---|---|---|---|
| # | Gene Symbol | P1 | P3 | P4 | P5 | P6 | P7 | P8 |
| 155 | CENPB | x | x | x | x | | | x |
| 314 | TOP1 | x | x | x | x | | x | x |
| 1 | KDM6B | | x | x | x | x | x | x |
| 2 | BICD2 | | x | x | x | | | x |
| 3 | NSUN5 | | | x | x | | | x |
| 4 | RTEL1 | | | | x | | | x |
| 8 | TRIM21 | | | | x | x | x | x |
| 9 | ABCB8 | | | | x | | | x |
| 10 | AVEN | | | | x | | | x |
| 13 | CENPA | | | | x | | | x |
| 14 | CENPC1 | | | | x | | x | x |
| 15 | CENPT | | | | | | | x |
| 18 | GYS1 | | | | x | x | | x |
| 22 | MARVELD2 | | | | x | | | |
| 27 | PMF1 | | | | x | | | |
| 30 | TTLL3 | | | | x | | | |
| 40 | ALPK1 | | | | | x | | |
| 44 | ATP13A2 | | | | x | | | |
| 48 | C19orf52 | | | | | | | x |
| 75 | LTF | | | | x | | | |
| 92 | STMN4 | | | | x | x | | x |
| 108 | ACBD6 | | | | x | | | x |
| 115 | CBX3 | | | | | | | x |

TABLE 8-continued

Composition of the marker panels

| | | SSc diagnosis | | | | CENPB & Sc170 neg. | dSSc | lSSc |
|---|---|---|---|---|---|---|---|---|
| # | Gene Symbol | P1 | P3 | P4 | P5 | P6 | P7 | P8 |
| 118 | CENPH | | | | | | | x |
| 123 | EIF4E | | | | | | | x |
| 134 | GTF2F1 | | | | x | | | x |
| 137 | ISY1 | | | | | | x | |
| 138 | KDR | | | | x | | | |
| 140 | MAPT | | | | | | | x |
| 158 | SSB | | | | | | | x |
| 213 | DIP2C | | | | x | | | x |
| 224 | FXC1 | | | | x | | | |
| 227 | HNRNPA1 | | | | x | x | X | |
| 229 | HSBP1L1 | | | | x | | | |
| 232 | KARS | | | | x | | | |
| 257 | PBXIP1 | | | | x | | | x |
| 290 | ZNF431 | | | | x | | | |
| 292 | NEFL | | | | | | | x |
| 293 | STMN1 | | | | x | x | | x |
| 295 | PPP1R2 | | | x | x | | | |
| 297 | SSRP1 | | | | x | | | x |

Example 13: Application of Autoantibody Panels for Identification of Patients With Absent Detection of Anti-Centromere and Anti-Sc170 (Top1) Autoantibodies As presented in Table 6, only approximately 41% of the SSc patients from the SSc cohort II tested positively for anti-CENPB antibodies, and 25.3% tested positively for anti-Sc170 antibodies. Since very few patients with doubly positive reactivity have been described in the literature, the proportion of anti-CENPB- and anti-Sc170-negative patients was specified at approximately 30%. In order to close these diagnostic gaps, a logistic regression model was created for panel 6, which consists of 7 markers.

Panel 6 contains the markers KDM6B, TRIM21, GYS1, ALPK1, STMN4, HNRNPA1 and STMN1.

As summarised in Table 6, an AUC of 0.91 was achieved in cohort I, and an AUC of 0.84 was achieved for cohort II with the markers of panel 6.

Example 14: Application of Autoantibody Panels for Identification of SSc Patients With Diffuse Form As presented in table 6, 36.8% of the SSc patients with diffuse SSc (dSSc) and 25.3% of the patients with limited form were positively tested for autoantibodies against Sc170 (Top1). This shows that anti-Sc170 antibodies are indeed associated with the diffuse form, but are not specific. Additional markers are therefore required for diagnosis of the diffuse form. Panel 7 comprises 6 markers which are particularly suitable for the diagnosis of diffuse SSc.

Panel 7 contains the markers KDM6B, TOP1, TRIM21, CENPC1, ISY1 and HNRNPA1.

For panel 7 an AUC of 0.81 for cohort I and 0.87 for cohort II were calculated by means of a logistic regression.

Example 15: Application of Autoantibody Panels for Identification of SSc Patients With Limited Form As presented in Table 6, 41% of SSc patients with limited SSc (lSSc) and 8.8% of patients with diffuse form tested positively for autoantibodies against CENPB. This shows that anti-CENPB antibodies are indeed associated with the limited form, but are not specific. Additional markers are therefore required for diagnosis of the limited form. Panel 8 comprises 27 markers which are particularly suitable for the diagnosis of limited SSc.

Panel 8 comprises the markers KDM6B, BICD2, NSUN5, CENPB, TOP1, RTEL1, TRIM21, ABCB8, AVEN, CENPA, CENPC1, CENPT, GYS1, C19orf52, STMN4, ACBD6, CBX3, CENPH, EIF4E, GTF2F1, MAPT, SPTAN1, DIP2C, PBXIP1, NEFL, STMN1 and SSRP1.

For panel 8, an AUC of 0.97 for cohort I and 0.99 for cohort II were calculated by means of a logistic regression.

TABLE 9

AUC of the SSc panels in SSc cohort I and cohort II

| Panel | SSc Cohort | Comparison | AUC |
|---|---|---|---|
| Panel 1 | Cohort I | SSc vs HC | 0.81 |
| Panel 1 | Cohort I | SSc vs SLE | 0.84 |
| Panel 3 | Cohort I | SSc vs HC | 0.88 |
| Panel 3 | Cohort I | SSc vs SLE | 0.84 |
| Panel 4 | Cohort I | SSc vs HC | 0.90 |
| Panel 4 | Cohort I | SSc vs SLE | 0.84 |
| Panel 5 | Cohort I | SSc vs HC | 0.93 |
| Panel 6 | Cohort I | SSc CENPB & Scl70 neg vs HC | 0.91 |
| Panel 7 | Cohort I | dSSc vs HC | 0.81 |
| Panel 8 | Cohort I | lSSc vs HC | 0.97 |
| Panel 9 | Cohort I | SSc vs HC | 0.99 |
| Panel 1 | Cohort II | SSc vs HC | 0.85 |
| Panel 1 | Cohort II | SSc vs AI | 0.84 |
| Panel 3 | Cohort II | SSc vs HC | 0.87 |
| Panel 3 | Cohort II | SSc vs AI | 0.85 |
| Panel 4 | Cohort II | SSc vs HC | 0.88 |
| Panel 4 | Cohort II | SSc vs AI | 0.85 |
| Panel 5 | Cohort II | SSc vs HC | 0.96 |
| Panel 6 | Cohort II | SSc CENPB & Scl70 neg vs HC | 0.84 |
| Panel 7 | Cohort II | dSSc vs HC | 0.87 |
| Panel 8 | Cohort II | lSSc vs HC | 0.99 |
| Panel 9 | Cohort II | SSc vs HC | 0.99 |

Example 16: ELISA for the Determination of Anti-KDM6B Antibodies in Systemic Sclerosis In accordance with the invention, recombinantly produced and improved KDM6B protein (Seq ID 315) comprising amino acids 42-421 of the Uniprot Database Entry O15054 was used. KDM6B is purified over a number of stages by means of nickel chelate affinity chromatography, size exclusion chromatography, and ion exchanger chromatography. The purified KDM6B was then applied in a concentration of 1 µg per millilitre in an Na carbonate buffer pH 9.0 to a flat-bottom ELISA plate (for example NUNC) with 100 µl per cavity, and was incubated for 4h at room temperature (RT).

After incubation, the excess buffer was removed and the free binding points of the ELISA plate were blocked using an inert protein (cold water fish gelatin) in PBS for 1 h at room temperature.

Serum or plasma samples were diluted 1:101 in HBS-T buffer, applied to the cavities and incubated for 30 min at room temperature. During this time, the KD6MB specific IgG autoantibodies from the serum or plasma sample bind to the bound protein.

Non-specifically-bound antibodies are removed after the incubation by washing twice with a PBS Tween buffer. Incubation is then performed for half an hour with an HRP (horseradish-peroxidase-conjugated) anti-human IgG detection antibody. After the incubation, non-specific binding partners are again removed by washing twice with PBS tween buffer.

The colorimetric detection reaction is performed by addition of a TMB (tetramethylbenzidine) substrate. This reaction is stopped after 15 minutes by addition of a 1M sulphuric acid and is evaluated in an ELISA measuring device (TECAN) at a wavelength of 450 nm vs 620 nm. The colour intensity (optical density, OD) of the detection reaction is directly proportional to the concentration of the KDM6B-specific IgG autoantibodies in the serum or plasma sample.

The test is evaluated semi-quantitatively via one-point calibration.

The OD values of the anti-KDM6B ELISA were used for the calculation of the p-values by means of Wilcoxon rank sum test and the calculation of a logistic regression model with ROC analysis for the comparison of SSc against HC. Since the group of SSc patients is greater than that of the control group HC, a random under-sampling is carried out for the logistic regression, such that the SSc cohort II has groups of identical size. The ROC analysis was calculated by using 75% of this reduced data set of SSc cohort II for training and 25% for testing the model. This approach is repeated 100 times.

Table 10 shows the p-values for the comparison of SSc versus healthy controls and SSc versus autoimmune controls calculated from samples of SSc cohort II.

Table 11 shows the empirically calculated area under the curve (AUC), sensitivity, and specificity of the anti-KDM6B ELISA for the diagnosis of SSc (SSc cohort II) compared to healthy samples.

FIG. 12 shows ROC curve for a logistic regression model on the basis of the ELISA OD values of KDM6B for the diagnosis of SSc compared to healthy controls.

Example 17: ELISA for the Determination of Anti-BICD2 Antibodies in Systemic Sclerosis In accordance with the invention, recombinantly produced BICD2 protein was purified over a number of stages by means of nickel chelate affinity chromatography, size exclusion chromatography, and ion exchanger chromatography. The purified BICD2 was then applied in a concentration of 1.7 µg per millilitre in an Na carbonate buffer pH 9.0 to a flat-bottom ELISA plate (for example NUNC) with 100 µl per cavity, and was incubated for 4 h at room temperature (RT).

After incubation, the excess buffer was removed and the free binding points of the ELISA plate were blocked using an inert protein (cold water fish gelatin) in PBS for 1 h at room temperature.

Serum or plasma samples were diluted 1:101 in HBS-T buffer, applied to the cavities and incubated for 30 min at room temperature. During this time, the BICD2-specific IgG autoantibodies from the serum or plasma sample bind to the bound protein.

Non-specifically-bound antibodies are removed after the incubation by washing twice with a PBS Tween buffer. Incubation is then performed for half an hour with an HRP (horseradish-peroxidase-conjugated) anti-human IgG detection antibody. After the incubation, non-specific binding partners are again removed by washing twice with PBS tween buffer.

The colorimetric detection reaction is performed by addition of a TMB (tetramethylbenzidine) substrate. This reaction is stopped after 15 minutes by addition of a 1M sulphuric acid and is evaluated in an ELISA measuring device (TECAN) at a wavelength of 450 nm vs 620 nm. The colour intensity of the detection reaction is directly proportional to the concentration of the BICD2-specific IgG autoantibodies in the serum or plasma sample.

The OD values of the BICD2 antigen were used for the calculation of the p-values by means of Wilcoxon rank sum test and the calculation of the receiver operator curves (ROC).

The OD values of the anti-BICD2 ELISA were used for the calculation of the p-values by means of Wilcoxon rank sum test and the calculation of a logistic regression model with ROC analysis for the comparison of SSc against HC. Since the group of SSc patients is greater than that of the control group HC, a random under-sampling is carried out for the logistic regression, such that the SSc cohort II has groups of identical size. The ROC analysis was calculated by using 75% of this reduced data set of SSc cohort II for training and 25% for testing the model. This approach is repeated 100 times.

Table 10 shows the p-values for the comparison of SSc versus healthy controls (HC) and SSc versus autoimmune controls (AD) calculated from samples of SSc cohort II.

TABLE 10

Wilcoxon rank sum test (p-value) for anti-KDM6B and anti-BICD2 ELISA for the diagnosis of SSc compared to healthy controls.

| Comparison | KDM6B | BICD2 |
|---|---|---|
| SSc vs HC | 1.05E−04 | 1.13E−04 |

FIG. 11 shows the boxplot of the BICD2 ELISA for SSc samples compared to healthy samples.

Table 11 shows the empirically calculated sensitivity and specificity of the anti-KDM6B and anti-BICD2 ELISA for SSc cohort II for the diagnosis of SSc compared to healthy controls

| ELISA | Test | Value |
|---|---|---|
| anti-KDM6B | AUC | 0.63 |
|  | Sensitivity | 0.19 |
|  | Specificity | 0.90 |
| anti-BICD2 | AUC | 0.64 |
|  | Sensitivity | 0.19 |
|  | Specificity | 0.95 |

FIG. 12 shows ROC curve with confidence bands for a logistic regression model based on the ELISA OD values of BICD2 for the diagnosis of SSc compared to healthy controls.

LITERATURE

Mehra S, Walker J, Patterson K, Fritzler M J (2013). Autoantibodies in systemic sclerosis. Autoimmun Rev. 12(3):340-54.

Mierau R, Moinzadeh P, Riemekasten G, Melchers I, Meurer M, Reichenberger F, Buslau M, Worm M, Blank N, Hein R, Müller-Ladner U, Kuhn A, Sunderkötter C, Juche A, Pfeiffer C, Fiehn C, Sticherling M, Lehmann P, Stadler R, Schulze-Lohoff E, Seitz C, Foeldvari I, Krieg T, Genth E, Hunzelmann N (2011). Frequency of disease-associated and other nuclear autoantibodies in patients of the German Network for Systemic Scleroderma: correlation with characteristic clinical features. Arthritis Res Ther. 13(5): R172

LeRoy E C, Black C, Fleischmajer R, Jablonska S, Krieg T, Medsger T A Jr, Rowell N, Wollheim F (1988). Scleroderma (systemic sclerosis): classification, subsets and pathogenesis. J Rheumatol. 15(2):202-5.

Watts R., (2006). Autoantibodies in the autoimmune rheumatic diseases, Medicine, 34 (11): 441-444

SEQUENCE LISTING (955 sequences)

SEQ ID NO: 1 - DNA, 1067 bp, Human
  misc_feature (786)..(786): n is a, c, g, or t
  misc_feature (804)..(804): n is a, c, g, or t
  misc_feature (836)..(836): n is a, c, g, or t
  misc_feature (847)..(847): n is a, c, g, or t
  misc_feature (867)..(867): n is a, c, g, or t
  misc_feature (877)..(877): n is a, c, g, or t
  misc_feature (879)..(879): n is a, c, g, or t
  misc_feature (891)..(891): n is a, c, g, or t
  misc_feature (906)..(906): n is a, c, g, or t
  misc_feature (942)..(942): n is a, c, g, or t
  misc_feature (946)..(946): n is a, c, g, or t
  misc_feature (955)..(955): n is a, c, g, or t
  misc_feature (957)..(958): n is a, c, g, or t
  misc_feature (962)..(962): n is a, c, g, or t
  misc_feature (971)..(971): n is a, c, g, or t
  misc_feature (976)..(976): n is a, c, g, or t
  misc_feature (982)..(982): n is a, c, g, or t
  misc_feature (984)..(984): n is a, c, g, or t
  misc_feature (988)..(988): n is a, c, g, or t
  misc_feature (995)..(995): n is a, c, g, or t
  misc_feature (1004)..(1004): n is a, c, g, or t
  misc_feature (1007)..(1007): n is a, c, g, or t
  misc_feature (1014)..(1014): n is a, c, g, or t
  misc_feature (1016)..(1016): n is a, c, g, or t
  misc_feature (1020)..(1020): n is a, c, g, or t
  misc_feature (1025)..(1025): n is a, c, g, or t
  misc_feature (1028)..(1028): n is a, c, g, or t
  misc_feature (1032)..(1032): n is a, c, g, or t
  misc_feature (1051)..(1051): n is a, c, g, or t
  misc_feature (1064)..(1064): n is a, c, g, or t
tagagaaattactatgagaggatcgcatcaccatcaccatcacggatcctatttaggtgacactatagaatcgtcgacccacgcgtccgggctgcctggaggcagatgctcagccagcattgggcagcccccgcttcctgctcccctacccccttcacatggcagtagttctgggcaccccagcaaaccatattatgctccaggggcgcccactccaagacccctccatgggaagctggaatccctgcatggctgtgtgcaggcattgctccgggagccagcccagccagggctttgggaacagcttgggcaactgtacgagtcagagcacgatagtgaggaggccacacgctgctaccacagcgcccttcgatacggaggaagcttcgctgagctggggccccgcattggccgactgcagcaggcccagctctggaactttcatactggctcctgccagcaccgagccaaggtcctgcccccactggagcaagtgtggaacttgctacaccttgagcacaaacggaactatggagccaagcggggaggtcccccggtgaagcgagctgctgaacccccagtggtgcagcctgtgcctcctgcagcactctcaggcccctcaggggaggagggcctcagccctggaggcaagcgaaggagaggctgcaactctgaacagactggccttcccccagggctgccactgcctccaccaccattaccaccaccaccaccaccaccaccaccaccaccaccaccaccacccctgcctggcctggctaccanccccccatttcagctaancaagccagggctgtggagtaccctgcatgganatgcctggggncccaaagcgcaagggttcancaccccccanancgccaggagcancggcactcgctgccntcacccatatccatacccagctccagcgtaaaccgngcanccccctggncnncggntggtccggntgctnccccangnccangcccccnccccccaanaanaaaaaancntggntggcntgnctgncacccgtcccccggaaatnaccttaaaaaaanaaa

SEQ ID NO: 2 - DNA, 1080 bp, Human
gtgagcggataacaattataatagattcaattgtgagcggataacaatttcacacagaattcattaaagaggagaaattaactatgagaggatcgcatcaccatcaccatcacggtcgacccacgcgtccggacagcccctcgcctggctcctcactgccatcacccctgagtgacccacgccgggagcccatgaacatctacaacctgatcgctatcatccgtgaccagatcaagcacctgcaggcagccgtggaccgcaccacggagctgtcacgccagcgcattgcctctcaggagctgggccccgccgtggacaaggacaaggaagcgcttatggaggagatcctcaagctgaagtcgctgctcagcaccaagcgggagcagatcaccacgctgcgcactgtgctcaaggccaacaagcagacggccgaggtggcccttgccaacctgaagagcaagtatgagaatgagaaggccatggttaccgagaccatgatgaagctgcgcaatgagctcaaggccctcaaggaggacgcagccaccttctcctcgctgcgtgctatgtttgccaccaggtgtgacgagtacattacacagctggatgagatgcagcggcagctggcggctgctgaggacgagaagaagacgctgaactcgctgctgcgcatggccatccagcagaagctggcgctgacccagcggctggagctgctcgagctggaccatgagcagacccggcgtggccgtgccaaagccgccccgaagaccaagccagccacaccgagcctgtagagtagctgccaggaggacttggccacccggccctgtcacactgcagccccttccccttccctctcgtggcccacaaggaggaaggaagggcaacctaaaagcccacttagaaactttttggatatgccactgcaattcttttcaaaatagcattccccaggtttttaatgggaggaaaaaaagctttaatgttgagcatgctgcgagctgctgcgtggaaaggcctctgtatgggccgaagacccttcttccctggctgccaggctcgccaggagcccactggaaa

SEQ ID NO: 3 - DNA, 1088 bp, Human
attataatagattcaattgtgagcggataacaatttcacacagaaatcattaaagaggagaaattaactatgagaggatcgcatcaccatcaccatcacggatcctatttaggtgacactatagaatcgtcgactctggaccttggctgtcactcagttagacaaggtttctcctatcagggtcgggcttccagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggaccccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcccgggctggcgtctcttgctgtgaactggctgaggaggacttcctggcggtctccccctcggatccacgctaccatgaggtccactacatcctgctggatccttcctgcagtggctcgggtatgccgagcagacagctggaggagcccggggcaggcacacctagcccggtgcgtctgcatgccctggcagggttccagcagcgagccctgtgccacgcgctcactttcccttccctgcagcggctcgtctactccacgtgctccctctgccaggaggagaatgaagacgtggtgcgagatgcgctgcagcagaacccgggcgccttcaggctagctcccgccctgcctgcctggccccaccgaggcctgagcacgttcccgggtgccgagcactgcctccgggcctcccctgagaccacactcagcagtggcttcttcgttgctgtaattgaacgggtcgaggtgccaagctcagcctcacaggccaaagcatcagcaccagaacgcacacccagcccagccccaaagagaaagaagagacagcaaagagccgcagccggtgcttgcacaccgccttg

SEQ ID NO: 4 - DNA, 1122 bp, Human
tttgtgagcggataacaattataatagattcaattgtgagcggataacaatttcacacagaattcattaaagaggagaaattaactatgagaggatcgcatcaccatcaccatcacggatcctatttaggtgacactatagaatcgtcgactctggaccttggctgtcactcagttaaacagcgcttctcacagacgtgcacagacctgaccggccggccctacccgggcatggagccaccgggaccccaggaggagaggcttgccgtgtctcctgtgcttacccacagggctccccaaccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggtgagcctcatgggagagacatcgctgggcagcaggccacgggagctccgggcgggcccctctcagcaggctgtgtgtgccagggctgtggggcagaggacgtggtgcccttccagtgccctgcctgtgacttccagcgctgccgagcctgctggcaacggcaccttcaggcctctaggatgtgcccagcctgccacaccgcctccaggaagcagagcgtcatgcaggtcttctggccagagccccagtgagtgcccacggaggcccccagcacacccaacgtggcttgatcacctgcctgtccagctctggtgggccaagaacccacccaacagaataggccagcccatgccagccggcttggcccgctgcaggcctcaggcaggcggggcccatggttggtccctgcggtgggaccggatctgggcctgcctctgagaagccctgagctaccttggggtctggggtgggtttctgggaaagtgcttccccagaacttccctggctcctggcctgtgagtggtgccacaggggcaccccagctgagcccctcaccgggaaggaggagacccccgtgggcacgtgtccacttttaatcaggggacagggctctctaataaagctgctggcagtgcccaaaaaaaaaaaaaaaaaaaaaaaaaaacg

SEQ ID NO: 5 - DNA, 1092 bp, Human
ttgctttgtgagcggataacaattataatagattcaattgtgagcggataacaatttcacacccaattcattaaagaggagaaattaactatgagaggatcgcatcaccatcaccatcacggtcgacccacgcgtccggcactagggatcgtccgcaggattgggactgatacagaggccgccacggagcccgccggagccaccgttcctgctgctgccgccgctgcccgaatcggaaccgtcgggccgcagccgccggcaatgccgcgaaggaagaggaatgcaggcagtagttcagatggaaccgaagattccgatttttctacagatctcgagcacacagacagttcagaaagtgatggcacatcccgacgatctgctcgagtcacccgctcctcagccaggctaagccagagttctcaagattccagtcctgttcgaaatctgcagtcttttggcactgaggagcctgcttactctaccagaagagtgacccgtagtcagcagcagcctaccccagtgacaccgaaaaaataccctcttcggcagactcgttcatctggttcagaaactgagcaagtggttgatttttcagatagagaaactaaaaatacagctgatcatgatgagtcaccgcctcgaactccaactggaaatgcgccttcttctgagtctgacatagacatctccagccccaatgtatctcacgatgagagcattgccaaggacatgtccctgatggactcaggcagtgatctctctcatcgccccaagcgccgtcgcttccatgaaagctacaacttcaatatgaagtgtcctacaccaggctgtaactctctaggacaccttacaggaaaacatgagagacatttctccatctcaggatgcccactgtatcataacctctcagctgacgaatgcaaggtgagagcacagagccgggataagcagatagaagaaaggatgctgtctcacaggcaagatgacaacaacaggcatgcaaccaggcaccaggcaccaacggagaggcagcttcgatataaggaaaaagtggctgaactcaggaagaaaagaaattctggactgagcaaa

SEQ ID NO: 6 - DNA, 1128 bp, Human
ttgtgagcggataacaattataatagattcaattgtgagcggataacaatttcacacagaattcattaaagaggagaaattaactatgagaggatcgcatcaccatcaccatcacggatcctatttaggtgacactatagaatcgtcgacccacgcgtccgcttggctgactcaccgccctcgccgccgcaccatggacgcccccaggcaggtggtcaactttgggcctggtcccgccaagctgccgcactcagtgttgttagagatacaaaaggaattattagactacaaaggagttggcattagtgttcttgaaatgagtcacaggtcatcagattttgccaagattattaacaatacagagaatcttgtgcgggaattgctagctgttccagacaactataaggtgatttttctgcaaggaggtgggtgcggccagttcagtgctgtccccttaaacctcattggcttgaaagcaggaaggtgtgcggactatgtggtgacaggagcttggtcagctaaggccgcagaagaagccaagaagtttgggactataaatatcgttcaccctaaacttgggagttatacaaaaattccagatccaagcacctggaacctcaacccagatgcctcctacgtgtattattgcgcaaatgagacggtgcatggtgtggagtttgactttatacccgatgtcaagggagcagtactggtttgtgacatgtcctcaaacttcctgtccaagccagtggatgtttccaagtttggtgtgatttttgctggtgcccagaagaatgttggctctgctggggtcaccgtggtgattgtccgtgatgacctgctggggtttgccctccgagagtgcccctcggtcctggaatacaaggtgcaggctggaaacagctccttgtacaacacgcctccatgtttcagcatctacgtcatgggcttggttctggagtggattaaaaacaatggaggtgccgcggccatggagaagcttagctccatcaaatctcaaacaatttatgagattattgataattctcaaggattctacgtttgtccagtggagccccaaaatagaagcaagatgaatattccattccgcattggcaatgccaaagg

SEQ ID NO: 7 - DNA, 1056 bp, Human
ttgctttgtgagcggataacaaattataatagattcaattgtgagcggataacaatttcacaccgaattcattaaagaggagaaattaactatgagaggatcgcatcaccatcaccatcacggatcctatttaggtgacactatagaatcgtcgactctggaccttggctgtcactcagttatcaaggagcggaagctgtgtgcctatcctcggctggagatctaccaggaagaccagatccatttcatgtgcccactggcacggcagggagacttctatgtgcctgagatgaaggagacagagtggaaatggcgggggcttgtggaggccattgacacccaggtggatggcacaggagctgacacaatgagtgacacgagttctgtaagcttggaagtgagccctggcagccgggagacttcagctgccacactgtcacctggggcgagcagccgtggctgggatgacggtgacacccgcagcgagcacagctacagcgagtcaggtgccagcggctcctcttttgaggagctggacttggagggcgaggggcccttaggggagtcacggctggaccctgggactgagcccctggggactaccaagtggctctgggagcccactgcccctgagaagggcaaggagtaacccatggcctgcaccctcctgcagtgcagttgctgaggaactgagcagactctccagcagactctccagccctcttcctccttcctctgggggaggaggggttcctgagggacctgacttcccctgctccaggcctcttgctaagccttctcctcactgccctttaggctcccagggccagaggagccagggactattttctgcaccagcccccagggctgccgcccctgttgtgtcttttttcagactcacagtggagcttccaggacccagaataaagccaatgatttacttgtttcaaaaaaaaaaaaaaaaaaaaaaaaaacgagcggccgctccctatagtgagtcgtattaagcttaattagctgaacttggactcctgttgatagatccagtaatgacct

SEQ ID NO: 8 - DNA, 1240 bp, Human
  misc_feature (836)..(836): n is a, c, g, or t
  misc_feature (876)..(876): n is a, c, g, or t
  misc_feature (902)..(902): n is a, c, g, or t
  misc_feature (908)..(908): n is a, c, g, or t
  misc_feature (914)..(914): n is a, c, g, or t
  misc_feature (921)..(921): n is a, c, g, or t
  misc_feature (923)..(923): n is a, c, g, or t
  misc_feature (941)..(941): n is a, c, g, or t
  misc_feature (967)..(967): n is a, c, g, or t
  misc_feature (1024)..(1024): n is a, c, g, or t
  misc_feature (1050)..(1050): n is a, c, g, or t
  misc_feature (1055)..(1055): n is a, c, g, or t
  misc_feature (1065)..(1065): n is a, c, g, or t
  misc_feature (1068)..(1068): n is a, c, g, or t
  misc_feature (1071)..(1071): n is a, c, g, or t
  misc_feature (1074)..(1074): n is a, c, g, or t
  misc_feature (1088)..(1088): n is a, c, g, or t
  misc_feature (1108)..(1108): n is a, c, g, or t
  misc_feature (1118)..(1118): n is a, c, g, or t
  misc_feature (1128)..(1128): n is a, c, g, or t
  misc_feature (1134)..(1134): n is a, c, g, or t
  misc_feature (1140)..(1140): n is a, c, g, or t
  misc_feature (1143)..(1143): n is a, c, g, or t
  misc_feature (1146)..(1146): n is a, c, g, or t
  misc_feature (1148)..(1148): n is a, c, g, or t
  misc_feature (1154)..(1154): n is a, c, g, or t
  misc_feature (1158)..(1158): n is a, c, g, or t
  misc_feature (1171)..(1171): n is a, c, g, or t
  misc_feature (1175)..(1175): n is a, c, g, or t
  misc_feature (1187)..(1187): n is a, c, g, or t
  misc_feature (1204)..(1204): n is a, c, g, or t
  misc_feature (1209)..(1209): n is a, c, g, or t
  misc_feature (1215)..(1215): n is a, c, g, or t
  misc_feature (1219)..(1219): n is a, c, g, or t
  misc_feature (1225)..(1225): n is a, c, g, or t
  misc_feature (1227)..(1227): n is a, c, g, or t
  misc_feature (1238)..(1239): n is a, c, g, or t
tagagaaattactatgagaggatcgcatcaccatcaccatcacggatcctatttaggtgacactatagaatcgtcgacccacgcgtccggacttcacctgttctgtgagaaagatgggaaggccctttgctgggtatgtgcccagtctcggaaacaccgtgaccacgccatggtccctcttgaggaggctgcacaggagtaccaggagaagctccaggtggcattaggggaactgagaagaaagcaggagttggctgagaagttggaagtggaaattgcaataaagagagcagactggaagaaaacagtggaaacacagaaatctaggattcacgcagagtttgtgcagcaaaaaaacttcctggttgaagaagaacagaggcagctgcaggagctggagaaggatgagagggagcagctgagaatcctgggggagaaagaggccaagctggcccagcagagccaggccctacaggagctcatctcagagctagatcgaaggtgccacagctcagcactggaactgctgcaggaggtgataattgtcctggaaaggagtgagtcctggaacctgaaggacctggatattacctctccagaactcaggagtgtgtgccatgtgccagggctgaagaagatgctgaggacatgtgcagtccacatcactctggatccagacacagccaatccgtggctgatactttcagaagatcggagacaagtgaggcttggagacacccagcagagcatacctggaaatgaagagagatttgatagttatcctatggtcctgggtgcccagcactttcactctggaaaacattactgggaggtanatgtgacaggaaaggaggcctgggacctgggtgtctgcanagactctgtgcgcaggaaggggcacntttttngcttanttccaanantggcttctggacaatttnggttgtggaacaaacaaaaatatgangctggcacctaccccccaaactccccctccccctttcaggtgcctcccatgccaagnttgggatttttcctggactttgaagnctggnatggttctcnttnttnaanatcccttgaacaanggctcccctcatctactccnttctttgaangggccctttnaagganctttgnggnccntntttcantccnggtttccatgganggangaaaaaaacaanccccccttaaccctttntcccntgaaanttgnattccnangggtcccccgnnc

SEQ ID NO: 9 - DNA, 1070 bp, Human
  misc_feature (1)..(2): n is a, c, g, or t
  misc_feature (702)..(702): n is a, c, g, or t
  misc_feature (862)..(862): n is a, c, g, or t
  misc_feature (885)..(885): n is a, c, g, or t
  misc_feature (901)..(901): n is a, c, g, or t
  misc_feature (914)..(914): n is a, c, g, or t
  misc_feature (918)..(918): n is a, c, g, or t
  misc_feature (927)..(927): n is a, c, g, or t
  misc_feature (929)..(929): n is a, c, g, or t
  misc_feature (932)..(932): n is a, c, g, or t
  misc_feature (960)..(960): n is a, c, g, or t
  misc_feature (962)..(962): n is a, c, g, or t
  misc_feature (969)..(969): n is a, c, g, or t
  misc_feature (973)..(973): n is a, c, g, or t
  misc_feature (980)..(980): n is a, c, g, or t
  misc_feature (1016)..(1016): n is a, c, g, or t
  misc_feature (1023)..(1023): n is a, c, g, or t
  misc_feature (1026)..(1026): n is a, c, g, or t
  misc_feature (1047)..(1047): n is a, c, g, or t
  misc_feature (1049)..(1050): n is a, c, g, or t
  misc_feature (1052)..(1054): n is a, c, g, or t
  misc_feature (1056)..(1056): n is a, c, g, or t
  misc_feature (1058)..(1059): n is a, c, g, or t
  misc_feature (1061)..(1070): n is a, c, g, or t
nnattagagaaaattactatgagaggatcgcatcaccatcaccatcacggatcctatttaggtgacactatagaatcgtcgacccacgcgtccgcgctgccccctggcaagatcgtggccctcgtgggccagtctggcggaggaaagaccaccgtggcttccctgctggagcgcttctacgaccccacggcaggcgtggtgatgctggatgggcgggacctgcgcacccttgacccctcctggctccggggccaggttgtcggcttcatcagccaggagcccatcctgtttgggacgaccatcatggaaaacatccgctttgggaagctggaagcttccgatgaagaggtgtacacagccgcccgggaagcgaatgctcacgagttcatcaccagcttccccgagggctacaacacggtcgtcggtgaacggggcactaccctgtctgggggccagaagcagcgcctggccatcgcccgagcccttatcaagcagcccacggtgctgatactggatgaagctaccagcgcgctggatgcagagtccgagcgggttgtacaggaggccctggaccgggccagtgcaggccgcacggtgctggtaattgcccaccggctcagcactgtccgtggggcccactgcattgtcgtcatggccgatggccgtgtctgggaggctgggacacatgaagagctcctgaanaaaggcgggctatacgccgagctcatccggaggcaggccctggatgccccgaggacagcggcccccccgcccaaaaagccagaaggccccaggagccaccagcacaagtcctgagaaagggcccccctgaggtgtggtcgctgccaagcatcattgttanggctggggctcagcctgggggancctactggggactgancccccaggaaggnccancatgtgganantcnctgcggctgctcctgctcacaataaaancnggggccnaacnacttggnaaggggaggccaaattccctcccttccccttcccantcctgcnggntgctccctccaaaaaaaaaanannannnanannannnnnnnnnn

SEQ ID NO: 10 - DNA, 1267 bp, Human
  misc_feature (1)..(1): n is a, c, g, or t
  misc_feature (932)..(932): n is a, c, g, or t
  misc_feature (950)..(950): n is a, c, g, or t
  misc_feature (961)..(961): n is a, c, g, or t
  misc_feature (969)..(969): n is a, c, g, or t
  misc_feature (982)..(982): n is a, c, g, or t
  misc_feature (986)..(986): n is a, c, g, or t
  misc_feature (988)..(988): n is a, c, g, or t
  misc_feature (1011)..(1013): n is a, c, g, or t
  misc_feature (1021)..(1021): n is a, c, g, or t
  misc_feature (1031)..(1031): n is a, c, g, or t
  misc_feature (1034)..(1034): n is a, c, g, or t
  misc_feature (1041)..(1041): n is a, c, g, or t
  misc_feature (1050)..(1050): n is a, c, g, or t
  misc_feature (1054)..(1054): n is a, c, g, or t
  misc_feature (1056)..(1056): n is a, c, g, or t
  misc_feature (1078)..(1078): n is a, c, g, or t
  misc_feature (1084)..(1084): n is a, c, g, or t
  misc_feature (1087)..(1087): n is a, c, g, or t
  misc_feature (1096)..(1096): n is a, c, g, or t
  misc_feature (1098)..(1098): n is a, c, g, or t
  misc_feature (1108)..(1108): n is a, c, g, or t
  misc_feature (1119)..(1119): n is a, c, g, or t
  misc_feature (1130)..(1130): n is a, c, g, or t
  misc_feature (1136)..(1136): n is a, c, g, or t
  misc_feature (1149)..(1149): n is a, c, g, or t
  misc_feature (1155)..(1155): n is a, c, g, or t
  misc_feature (1162)..(1162): n is a, c, g, or t
  misc_feature (1165)..(1165): n is a, c, g, or t
  misc_feature (1170)..(1170): n is a, c, g, or t
  misc_feature (1176)..(1176): n is a, c, g, or t
  misc_feature (1180)..(1180): n is a, c, g, or t
  misc_feature (1182)..(1182): n is a, c, g, or t
  misc_feature (1185)..(1185): n is a, c, g, or t
  misc_feature (1187)..(1187): n is a, c, g, or t
  misc_feature (1189)..(1189): n is a, c, g, or t
  misc_feature (1196)..(1196): n is a, c, g, or t
  misc_feature (1200)..(1201): n is a, c, g, or t
  misc_feature (1232)..(1232): n is a, c, g, or t
  misc_feature (1234)..(1234): n is a, c, g, or t
  misc_feature (1247)..(1247): n is a, c, g, or t
  misc_feature (1258)..(1258): n is a, c, g, or t
  misc_feature (1261)..(1261): n is a, c, g, or t
ntattagagaaattactatgagaggatcgcatcaccatcaccatcacggatcctatttaggtgacactatagaatcgtcgacccacgcgtccgagaatgatgaacagggaaattattctaaaagaaagattgtctctaactgggatcgatatcaagatattgaaaaagaggtcaataatgaaagtggagagtcacagaggggaacagatttcagtgtcctccttagctctgcaggggactcattctcacagttccggtttgctgaggagaaagaatgggatagtgaagcttcttgtccaaaacagaattcagcattttatgtggatagtgagttattggttcgagcccttcaagagctgcctctctgcctccgactcaacgttgctgccgaactggtccagggtacagttcctttagaggttcctcaggtgaaaccaaagagaactgatgatggcaagggattagggatgcagttaaaggggcccttggggcctggaggaagggggcccatctttgagctgaaatctgtggctgctggctgccctgtgttgctgggcaaagacaacccaagcccgggtccttcaagggattctcagaaacccacttccccactgcagtcagcaggagaccatttggaagaagaactagatctgttgcttaatttagatgcacctataaaagagggagataacatcttaccagatcagacgtctcaggacctgaaatccaaggaagatggggaggtggtccaagaggaagaagtttgtgcaaaaccatctgtgactgaagaaaaaaacatggaacctgagcaaccaagtacctccaaaaatgttaccgaggaagagctggaagactggttggacagcatgatttcctaaaaaggggaaaaaaaagtgcctgaagcaaatcttggttgccttctaacggcaggngggcataaggctgtcctncaggacagccngtttacangcatgtctcagcntagngngttcccttttggctccccagcannnaaatgccnacccctgggnttngacctcngaaaaaaanaaantngaaacccccttggtgcaattgnttttcnggnctaaaaaancnaaaaaaattnccttagggcangaaaaaaaccnggcccntgtttctaacccncctccntggaggnttnaaacnaacccngggntnacngnanaccaaangctnntcgggaataaaaaaaaaatgcaaacagggcntncttttgcccaaanaaaaaatgggngcngcccca

SEQ ID NO: 11 - DNA, 624 bp, Human
atgagccctctgctccgccgcctgctgctcgccgcactcctgcagctggcccccgcccaggcccctgtctcccagcctgatgcccctggccaccagaggaaagtggtgtcatggatagatgtgtatactcgcgctacctgccagccccgggaggtggtggtgcccttgactgtggagctcatgggcaccgtggccaaacagctggtgcccagctgcgtgactgtgcagcgctgtggtggctgctgccctgacgatggcctggagtgtgtgcccactgggcagcaccaagtccggatgcagatcctcatgatccggtacccgagcagtcagctgggggagatgtccctggaagaacacagccagtgtgaatgcagacctaaaaaaaaggacagtgctgtgaagccagacagggctgccactccccaccaccgtccccagccccgttctgttccgggctgggactctgcccccggagcaccctccccagctgacatcacccatcccactccagccccaggcccctctgcccacgctgcacccagcaccaccagcgccctgacccccggacctgccgctgccgctgccgacgccgcagcttcctccgttgccaagggcggggcttag

SEQ ID NO: 12 - DNA, 1114 bp, Human
  misc_feature (858)..(858): n is a, c, g, or t
  misc_feature (860)..(861): n is a, c, g, or t
  misc_feature (863)..(869): n is a, c, g, or t
  misc_feature (871)..(876): n is a, c, g, or t
  misc_feature (899)..(899): n is a, c, g, or t
  misc_feature (910)..(910): n is a, c, g, or t
  misc_feature (913)..(913): n is a, c, g, or t
  misc_feature (918)..(918): n is a, c, g, or t
  misc_feature (953)..(953): n is a, c, g, or t
  misc_feature (974)..(974): n is a, c, g, or t
  misc_feature (978)..(978): n is a, c, g, or t
  misc_feature (1001)..(1002): n is a, c, g, or t
  misc_feature (1005)..(1005): n is a, c, g, or t
  misc_feature (1021)..(1021): n is a, c, g, or t
  misc_feature (1038)..(1038): n is a, c, g, or t
  misc_feature (1043)..(1043): n is a, c, g, or t
  misc_feature (1059)..(1060): n is a, c, g, or t
  misc_feature (1075)..(1075): n is a, c, g, or t
  misc_feature (1102)..(1103): n is a, c, g, or t
  misc_feature (1107)..(1107): n is a, c, g, or t
  misc_feature (1110)..(1110): n is a, c, g, or t
aaatagagaaattactatgagaggatcgcatcaccatcaccatcacggatcctatttaggtgacactatagaatcgtcgacccacgcgtccgccgagaccgcggcggagcctacggtccctgcagtgcctgctgctgaggaggccaccgaagctcggggacgcgaggagccggcgtggccctggaaagacgccccgatccggacgctggtgcagcgcatccaccagctgcaggctgagcgcgcgcagggcttccgccgactggaggagtggttggcgccggtgcagggcctgagagcctgggggcgcggcctcagggtccccacatgccgcagaggccaccgccagtacctgcgcagcggccctgactacgacttcgcgcgctaccggagcacagtgcacggggtgacccaggccttcgccgccgcctcgcgggaggtgctggcggtggaagcagagctgggcgggcctcgcaggcagccgctgctcgccggccacgtgcgcagcctgcaggagctggagcagacgcggctgggcacggtggccctgctgcagttgatggagacgccagagctggcggggcaggaggacgctgtacggatgcagcagctgaaaatgaaggtaattaaaaccatggaggcgatcagcgaggttctccaggaccttaggtttgatgcggaatctgccgagtgatggcggctccccagggatgcgccgagggagatgggaaacggggcggatggcgcccagcccagccctaactgccagctggctggggtcgcgccccactgcgctgctgaccttcctgcagttccagacacctcccacaataaagagctcctcctctgtaaaaaaaaaanannannnnnnnannnnnnaaagggcggccgctcccctatantgagtcttatnaancttanttaactgaacttggactccttgttgaaaaatccantaaatgacctcaaaatccatnttgnatttttttcaaaaacctcggttnnccnccggggcgtttttttntttggtgaaaatccaanctaanctttggcaaaattttnnggaacttaaggaacntaaaatggaaaaaaaaatccttggatnntccnccnttta

SEQ ID NO: 13 - DNA, 345 bp, Human
atgggcccgcgccgccggagccgaaagcccgaggccccgaggaggcgcagcccgagcccgaccccgacccccggcccctcccggcggggcccctccttaggcgcttcctcccatcaacacagtcggcggagacaaggttggctaaaggagatccgaaagcttcagaagagcacacacctcttgataaggaagctgcccttcagccgcctggcagcagaagcatttctagttcatctctttgaggacgcctatctcctcaccttacatgcaggccgagttactctcttcccaaaggatgtgcaactggcccggaggatccggggccttgaggagggactcggctga

SEQ ID NO: 14 - DNA, 1629 bp, Human
atggctgcgtccggtctggatcatctcaaaaatggctacagaagaagattttgtcgaccttccagggcacgtgacattaacacagagcaaggccagaatgttctggaaatcttacaagactgttttgaagaaaaaagtcttgccaatgattttagtacaaattctacaaaatcagtgcctaattcaacacgcaaaataaaagacacttgtattcagtcaccaagcaaagagtgccagaaatcacatccaaagtcagttccagtttcttcaaagaagaaagaagcctctctacagtttgttgtagaaccaagtgaagccacaaacagatcagttcaggcccatgaagttcatcagaaaattctggcaactgatgttagttccaaaaatacacctgactcgaaaaaaatatcaagtagaaacataaatgatcatcacagtgaagctgatgaagaattttacttatccgttggctcaccttctgttcttttggatgcaaaaacatctgtatcacaaaatgttattccatctagtgcccaaaagagagagacttacacttttgaaaattcagtaaatatgctgccttcaagtacagaggtttcagttaaaaccaaaaaaaggttaaactttgatgataaagttatgttaaagaaaatagaaatagataataaagtatcagatgaagaggataaaacatcggaaggacaagaaagaaaaccatcaggatcatctcagaatagaatacgagattcagaatatgaaattcaacgacaagctaaaaaaagtttttcaacattgtttttagaaacagtaaaacgaaaaagtgaatccagtcccattgttaggcatgcggcaactgctccacctcattcgtgtcctcccgatgatacgaagttgatagaggatgaatttataattgatgagtcggatcaaagttttgccagtagatcttggattacaataccaagaaaggcagggtctctgaaacaacgcacaatatccccggctgagagcactgcactccttcaaggtagaaagtcaagagaaaagcatcataatatattacctaagactttggcaaatgacaaacattcccataaacctcacccagtagagacatctcagccctctgataaaacagtactggatacaagttatgctttgataggtgaaacagtaaataattatagatctacaaaatatgaaatgtattccaagaatgcagaaaaaccatctagaagcaaaaggactataaaacaaaaacagagaagaaaattcatggctaaaccagctgaagaacagcttgatgtgggacagtctaaagatgaaaacatacatacatcacatattacccaagacgaatttcaaagaaattcagacagaaatatggaagagcatgaagagatgggaaatgattgtgtttccaaaaaacagatgccacctgtgggaagcaagaaaagtagcactagaaaagataaggaagaatctaaaaagaagcgcttttccagtgagtccaagaacaaacttgtacctgaagaagtgacttcaactgtcacgaaaagtcgaagaatttccaggcgtccatctgattggtgggtggtaaaatcagaggagagttgcctgaaatgctaa

SEQ ID NO: 15 - DNA, 884 bp, Human
  misc_feature (19)..(19): n is a, c, g, or t
  misc_feature (656)..(656): n is a, c, g, or t
  misc_feature (719)..(719): n is a, c, g, or t
  misc_feature (735)..(735): n is a, c, g, or t
  misc_feature (737)..(737): n is a, c, g, or t
  misc_feature (750)..(750): n is a, c, g, or t
  misc_feature (760)..(760): n is a, c, g, or t
  misc_feature (788)..(788): n is a, c, g, or t
  misc_feature (823)..(823): n is a, c, g, or t
  misc_feature (847)..(847): n is a, c, g, or t
  misc_feature (859)..(859): n is a, c, g, or t
  misc_feature (877)..(877): n is a, c, g, or t
  misc_feature (879)..(879): n is a, c, g, or t
ttattaaagaggagaaatnacttgagaggatcgcatcaccatcaccatcacggatcctatttaggtgacactatagaatcgtcgacccacgcgtccggggccgagacgatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccaggaagttgagtggccaaacaaggacgatagccagagggcgttcccatggagccaggtctgttggcagatcggcccatattcaggccagtgggcacttggaggaacagacacctcggacgctgctgaagaacatcctactaactgccccagaatcttccatcctgatgcctgagtcggtagtgaagccagtgccagcaccgcaggcggtccaaccctccagacaagagagcagttgcggcagcctggagctgcaacttcctgagctcgagccccccacaaccctggctccaggtctgctggcccctggcaggaggaaacagaggctgagactgtcagtgtttcagcagggagtggaccaggggctgtctctctcccaagagcctcaagggaatgctgatgcctnttccctcaccagatccctcaacctgacctttgccacacctcttcagccacagtcagtgcagangcctggcttggcccgnanaccttcagcccgncgagctgtanacgtgggtgccttttttgcgggatctgngaaatacttccctggctcctccaaacattggggtnggaggacacccagccgttcttttnagcccatgggtngggttcccccaagggggntnacttc

SEQ ID NO: 16 - DNA, 1428 bp, Human
atgaccctgcataataacagcaccaccagtccgctgtttccgaatattagcagcagctggattcatagcccgagtgatgcaggtctgcctccgggtacagttacccattttggtagctataatgttagccgtgcagcaggtaattttagcagtccggatggcaccaccgatgatccgctgggtggtcataccgtttggcaggttgttggtccgggtccgtttaaagttaataaacagctgaaaaccgtgaacaatggccctggtccgtatattatcatgaatcgttgggcactgggtaatctggcctgtggtcctggtccggatcgttattttagcattacccgtccgctgacctatcgtgcaaaacgtaccaccaaacgtggtccgggaccgcagtattttgttggtaaacgtaccgttccgcctggtgaatgttttattcagtttctgagcgaaccgggtccaggtccgcgtatctataaagaaaccgaaaaacgcaccaaagaactggctggtctgcaggcaagcggcaccgaagcagaaacagaaaattttgttcatccgaccggtagcagccgtagctgtagcagctatgaactgcagcagcagagcatgaaacgtagcaatcgtcgtaaatatggtcgttgccatttttggtttaccacgaaaagctggaaaccgagcagcgagcagatggatcaggatcatagcagcagtgatagctggaataataacgatgcagcagccagcctggaaaatagcgcaagcagtgatgaagaagatattggtagcgaaacccgtgccatttatagcattgttctgaaactgcctggtcatagcaccattctgaatagcaccaaactgccgagtagcgataatctgcaggttccggaagaggaactgggtatggttgatctggaacgtaaagcagataaactgcaggcacagaaaagcgttgatgatggtggtagctttccgaaaagctttagcaaactgcctattcagctggaaagcgcagttgataccgcaaaaaccagtgatgttaatagcagcgttggtaaaagcaccgcaaccctgccgctgagctttaaagaagcaaccctggccaaacgttttgccctgaaaacccgtagtcagattaccaaacgtaaacgtatgagcctggttaaagaaaaaaaagcagcacagaccggtcctggaccgttttgcgatagctgtattccgaaaaccggaccgggtccgaataaaacctttcgtaccacctttaaaatgctgctgctgtgtcagtgcgataaaaaaaaacgtcgtaaacagcagtatcagcagcgtcagagcgttatttttcataaacgtgcaccggaacaggcactgagatcttaagcggccgcctgggcctcatgggccttcctttcactgcccgctttccag

SEQ ID NO: 17 - DNA, 1206 bp, Human
  misc_feature (2)..(2): n is a, c, g, or t
  misc_feature (861)..(861): n is a, c, g, or t
  misc_feature (884)..(884): n is a, c, g, or t
  misc_feature (902)..(902): n is a, c, g, or t
  misc_feature (915)..(915): n is a, c, g, or t
  misc_feature (942)..(942): n is a, c, g, or t
  misc_feature (945)..(945): n is a, c, g, or t
  misc_feature (986)..(986): n is a, c, g, or t
  misc_feature (1006)..(1006): n is a, c, g, or t
  misc_feature (1029)..(1029): n is a, c, g, or t
  misc_feature (1048)..(1048): n is a, c, g, or t
  misc_feature (1081)..(1083): n is a, c, g, or t
  misc_feature (1103)..(1103): n is a, c, g, or t
  misc_feature (1105)..(1106): n is a, c, g, or t
  misc_feature (1110)..(1110): n is a, c, g, or t
  misc_feature (1113)..(1113): n is a, c, g, or t
  misc_feature (1124)..(1126): n is a, c, g, or t
  misc_feature (1129)..(1129): n is a, c, g, or t
  misc_feature (1131)..(1131): n is a, c, g, or t
  misc_feature (1133)..(1133): n is a, c, g, or t
  misc_feature (1138)..(1138): n is a, c, g, or t
  misc_feature (1145)..(1145): n is a, c, g, or t
  misc_feature (1150)..(1150): n is a, c, g, or t
  misc_feature (1169)..(1169): n is a, c, g, or t
  misc_feature (1174)..(1175): n is a, c, g, or t
  misc_feature (1177)..(1177): n is a, c, g, or t
  misc_feature (1188)..(1188): n is a, c, g, or t
cnaatagagagattactatgagaggatcgcatcaccatcaccatcacggatcctatttaggtgacactatagaatcgtcgacccacgcgtccgataactccaagtcagactcctgccgggaggtgactgtaactcccaacgcagcctggggtggagagggcagtctgggatgtggcattggctatgggtatctacaccggatcccaactcagccccccagctaccacaagaagccacctggcaccccaccaccttctgctctaccacttggtgccccaccacctgatgctctaccacctggacccacccccgaggactctccttccctggagacaggttccaggcagagtgactacatggaggccctgctgcaggcacctggctcctccatggaggatccccttcctgggcctgggagtcccagccacagtgctccagaccctgatggacttccccatttcatggagactcctcttcagcccccacctccagtgcagcgagttatggacccaggcttcctggacgtgtcgggaatttctctcttggacaacagcaatgccagtgtgtggcccagcctgccctcttccacagaactgaccaccacagctgtctcaacctcagggccagaggacatctgctccagcagcagttctcatgagcggggtggtgaggctacatggtctgggtcagagtttgaggtctccttcctggacagcccaggtgcccaagcccaggcggaccacctgcctcagctgactcttcctgacagtctcacctctgcagcctcaccaaaagatgggctgtccgccgagctgcttgaagctcaggctgaggaggaaccagcaagcacagagggcctanatactgggacggaagctgagggnctggacagccaggcccanatctctaccacanaataacaccctggggctgtgacaaggnccnatgatgaaatttcatgaggcccaaatgtgggcaggcagccngggctgcactatgcggtcangattcttgctgctttggtgggantgaaggcctcatgggtggngaaaaggggcccatgggcccttgggggaagaannnttttggccgggaaccctcangnncagnggntgggccctgcnnnggncncnggggnttcccanaaagnaaacagggtttggtcttantccanntnaaaaaaaattnaaaaaaaaagggtttctt

SEQ ID NO: 18 - DNA, 1312 bp, Human
  misc_feature (1)..(1): n is a, c, g, or t
ncccctcgctccataagaatactagagaggacgcatcaccatcaccatcacggtcgacccacgcgtccgtatgaatccttactggttgggagccttcccgacatgaacaagatgctggataaggaagacttcactatgatgaagagagccatctttgcaacgcagcggcagtctttcccccctgtgtgcacccacaatatgctggatgactcctcagaccccatcctgaccaccatccgccgaatcggcctcttcaatagcagtgccgacagggtgaaggtgattttccacccggagttcctctcctccacaagccccctgctccctgtggactatgaggagtttgtccgtggctgtcaccttggagtcttcccctcctactatgagccttggggctacacaccggctgagtgcacggttatgggaatccccagtatctccaccaatctctccggcttcggctgcttcatggaggaacacatcgcagacccctcagcttacggtatctacattcttgaccggcggttccgcagcctggatgattcctgctcgcagctcacctccttcctctacagtttctgtcagcagagccggcggcagcgtatcatccagcggaaccgcacggagcgcctctccgaccttctggactggaaatacctaggccggtactatatgtctgcgcgccacatggcgctgtccaaggcctttccagagcacttcacctacgagcccaacgaggcggatgcggcccaggggtaccgctacccacggccagcctcggtgccaccgtcgccctcgctgtcacgacactccagcccgcaccagagtgaagacgaggaggatccccggaacgggccgctggaggaaaacggcgaacgctacgatgaagaccaagaaggccgccaaaggaccgtcgcaaatccgtgcaccaaaatgggcaggcccaaccgtcctgcacctccctccaccagcgccagcaaacccaactctggtgaacaaggccccctccaggtcaattccgccaccccgagcgaaccccctcaaccccacccacttccctgggccgaggaagccgcaataaagccctccccacccaaactccccgactgatactgccaccacggtcccaaaaaaaaaaaataaaaagagctcatcatccataacccccctctccaacattcactggatgtgattaactaacacccacaatccatcactacaacaaccccacaccctcctcaacaaaaagacttaaccaaactgaccaccaccccatacccacacacacccccatctcaactaaaactcacca

SEQ ID NO: 19 - DNA, 921 bp, Human
  misc_feature (2)..(2): n is a, c, g, or t
  misc_feature (713)..(713): n is a, c, g, or t
  misc_feature (718)..(718): n is a, c, g, or t
  misc_feature (752)..(752): n is a, c, g, or t
  misc_feature (764)..(764): n is a, c, g, or t
  misc_feature (769)..(769): n is a, c, g, or t
  misc_feature (776)..(776): n is a, c, g, or t
  misc_feature (779)..(779): n is a, c, g, or t
  misc_feature (789)..(789): n is a, c, g, or t
  misc_feature (802)..(802): n is a, c, g, or t
  misc_feature (806)..(806): n is a, c, g, or t
  misc_feature (814)..(814): n is a, c, g, or t
  misc_feature (821)..(821): n is a, c, g, or t
  misc_feature (825)..(825): n is a, c, g, or t
  misc_feature (828)..(828): n is a, c, g, or t
  misc_feature (831)..(831): n is a, c, g, or t
  misc_feature (835)..(835): n is a, c, g, or t
  misc_feature (838)..(838): n is a, c, g, or t
  misc_feature (842)..(842): n is a, c, g, or t
  misc_feature (847)..(847): n is a, c, g, or t
  misc_feature (858)..(858): n is a, c, g, or t
  misc_feature (860)..(860): n is a, c, g, or t
  misc_feature (865)..(865): n is a, c, g, or t
  misc_feature (878)..(879): n is a, c, g, or t
  misc_feature (884)..(884): n is a, c, g, or t
  misc_feature (886)..(886): n is a, c, g, or t
  misc_feature (897)..(898): n is a, c, g, or t
  misc_feature (907)..(907): n is a, c, g, or t
  misc_feature (910)..(910): n is a, c, g, or t
  misc_feature (917)..(917): n is a, c, g, or t
  misc_feature (919)..(919): n is a, c, g, or t
antagagaaattactatgagaggatcgcatcaccatcaccatcacggatcctatttaggtgacactatagaatcgtcgacccacgcgtccgctcctccagtgctgtgcgcatggcagtgggctgcctgctggagctggccttcaaggtggctgcaggagagctcaagaatggatttgccatcatccggcccccaggacaccacgccgaggaatccacagccatgggattctgcttcttcaactctgtagccatcaccgcaaaactcctacagcagaagttgaacgtgggcaaggtcctcatcgtggactgggacattcaccatggcaatggcacccagcaggcgttctacaatgacccctctgtgctctacatctctctgcatcgctatgacaacgggaacttctttccaggctctggggctcctgaagaggttggtggaggaccaggcgtggggtacaatgtgaacgtggcatggacaggaggtgtggacccccccattggagacgtggagtaccttacagccttcaggacagtggtgatgcccattgcccacgagttctcacctgatgtggtcctagtctccgccgggtttgatgctgttgaaggacatctgtctcctctgggtggctactctgtcaccgccagatgttttggccacttgaccaggcagctgatgaccctggcagggggccgggtggtgctggccctgganggagnccatgacttgaccgccatctgtgatgcctctgangcttgtgtctcnggctntgctcantgnaaaactgcancccttggaatgangcantcttgcancaaaaancccnaanatncacncantggnccacnctaaaaaaaantncttcnaaaattccaaaannaaaancntggaaacttgnntgcaaaaanttnccccccntngt

SEQ ID NO: 20 - DNA, 1091 bp, Human
  misc_feature (58)..(58): n is a, c, g, or t
  misc_feature (834)..(834): n is a, c, g, or t
  misc_feature (860)..(860): n is a, c, g, or t
  misc_feature (885)..(885): n is a, c, g, or t
  misc_feature (887)..(887): n is a, c, g, or t
  misc_feature (902)..(902): n is a, c, g, or t
  misc_feature (910)..(910): n is a, c, g, or t
  misc_feature (943)..(943): n is a, c, g, or t
  misc_feature (954)..(954): n is a, c, g, or t
  misc_feature (961)..(961): n is a, c, g, or t
  misc_feature (967)..(967): n is a, c, g, or t
  misc_feature (975)..(975): n is a, c, g, or t
  misc_feature (982)..(982): n is a, c, g, or t
  misc_feature (984)..(984): n is a, c, g, or t
  misc_feature (988)..(988): n is a, c, g, or t
  misc_feature (999)..(999): n is a, c, g, or t
  misc_feature (1005)..(1006): n is a, c, g, or t
  misc_feature (1009)..(1009): n is a, c, g, or t
  misc_feature (1011)..(1011): n is a, c, g, or t
  misc_feature (1018)..(1018): n is a, c, g, or t
  misc_feature (1024)..(1024): n is a, c, g, or t
  misc_feature (1026)..(1026): n is a, c, g, or t
  misc_feature (1034)..(1034): n is a, c, g, or t
  misc_feature (1037)..(1037): n is a, c, g, or t
  misc_feature (1046)..(1046): n is a, c, g, or t
  misc_feature (1060)..(1061): n is a, c, g, or t
  misc_feature (1067)..(1067): n is a, c, g, or t
  misc_feature (1069)..(1070): n is a, c, g, or t
  misc_feature (1083)..(1083): n is a, c, g, or t
aatagagaaattactatgagaggatcgcatcaccatcaccatcacggatcctatttangtgacactatagaatcgtcgacccacgcgtccggccgcccgcccggggtgtggagcccggccgctgctcgcgggctgagtgtctgtcgctgctgccgcctccacccagcctccgccatggacctcttcggggacctgccggagcccgagcgctcgccgcgcccggctgccgggaaagaagctcagaaaggacccctgctctttgatgacctccctccggccagcagtactgactcaggatcagggggacctttgctttttgatgatctcccacccgctagcagtggcgattcaggttctcttgccacatcaatatcccagatggtaaagactgaagggaaaggagcaaagagaaaaacctccgaggaagagaagaatggcagtgaagagcttgtggaaaagaaagtttgtaaagcctcttcggtgatctttggtctgaagggctatgtggctgagcggaagggtgagagggaggagatgcaggatgcccacgtcatcctgaacgacatcaccgaggagtgtaggcccccatcgtccctcattactcgggtttcatattttgctgtttttgatggacatggaggaattcgagcctcaaaatttgctgcacagaatttgcatcaaaacttaatcagaaaatttcctaaaggagatgtaatcagtgtagagaaaaaccgtgaagagatgccttttggacactttcaagcatactgatgaagagtttccttaaacaagcttccagccaaaaagcctgcctggaaaagatgggtccactgnccacgtgtgttctggctgtaaacaanattctttatattgccaacctcggananaagtccgggcaatcntgtgttcnttataatgaggaaaagtcaaaaacatgcagccnttaaaccctcnacaaaanagcatnaatcccanctcattntnaaanagcggaatgangatacnnaangntggaagnaaactncngggatggnccntgttttggncctgctaaaaggtnncccccncnnttgggaagggaantaaaaccc

SEQ ID NO: 21 - DNA, 918 bp, Human
  misc_feature (895)..(918): n is a, c, g, or t
gagaaattactatgagaggatcgcatcaccatcaccatcacggatcctatttaggtgacactatagaatcgtcgacccacgcgtccgggaacccggagacgaaggaagacaccgtgttccttaagagggagtatacgtttcctcgccatttatccaatggagtttcctcttacctacttaacaggaacagggaaagggtgtcccccaacgaaaagcacttggttctgcttcgagatggaaggacacttataggctttttaagaagcattgatcaatttgcaaacttagtgctacatcagactgtggagcgtattcatgtgggcaaaaaatacggtgatattcctcgagggatttttgtggtcagaggagaaaatgtggtcctactaggagaaatagacttggaaaaggagagtgacacacccctccagcaagtatccattgaagaaattctagaagaacaaagggtggaacagcagaccaagctggaagcagagaagttgaaagtgcaggccctgaaggaccgaggtctttccattcctcgagcagatactcttgatgagtactaatcttttgcccagaggctgttggctcttgaagagtaggggctgtcactgagtgaaagtgacatcctggccacctcacgcatttgatcacagactgtagagttttgaaaagtcacttttatttttaattattttacatatgcaacatgaagaaatcgtgtaggtgggttttttttttaataacaaaatcactgtttaaagaaacagtggcatagactccttcacacatcactgtggcaccagcaactacttctttatattgttcttcatatcccaaattagagtttacagggacagtcttcatttacttgtaaataaaatatgaatctccnnnnnnnnnnnnnnnnnnnnnnnn

SEQ ID NO: 22 - DNA, 658 bp, Human
tagagagatactatgagaggtcgcatcaccatcaccatcacggatcctatttaggtgacactatagaatcgtcgactctggaccttggctgtcactcagtttttagtgctttggtttgcctaaagttatggaggcatgaggcagctcggagacatagagaatatatggaacaacaggagataaatgagccatcattgtcatcgaaaaggaaaatgtgtgaaatggccaccagtggtgacagacaaagagactcagaagttaatttcaaggaactgagaacagcaaaaatgaaacctgaactactgagtggacacatccccccaggccacattcctaaacctatcgtgatgcccgactatgtggcaaaataccctgtgattcagacagatgatgagcgagaacgctataaagctgtgttccaagaccagttttcagagtacaaagagctgtctgcagaagttcaggctgtcctgaggaagtttgatgagctggatgcagtgatgagcagattgccacatcattcggaaagccgacaggaacatgagagaatttcaagaatccatgaagagtttaagaaaaaaaagaatgatcctacatttctggaaaaaaaagaacgctgtgattacctaaagaataaactttctcacataaagcaaag

SEQ ID NO: 23 - DNA, 1181 bp, Human
  misc_feature (860)..(860): n is a, c, g, or t
  misc_feature (863)..(863): n is a, c, g, or t
  misc_feature (872)..(872): n is a, c, g, or t
  misc_feature (890)..(890): n is a, c, g, or t
  misc_feature (922)..(922): n is a, c, g, or t
  misc_feature (926)..(926): n is a, c, g, or t
  misc_feature (965)..(965): n is a, c, g, or t
  misc_feature (976)..(977): n is a, c, g, or t
  misc_feature (986)..(986): n is a, c, g, or t
  misc_feature (989)..(989): n is a, c, g, or t
  misc_feature (994)..(994): n is a, c, g, or t
  misc_feature (1008)..(1008): n is a, c, g, or t
  misc_feature (1013)..(1013): n is a, c, g, or t
  misc_feature (1021)..(1022): n is a, c, g, or t
  misc_feature (1024)..(1024): n is a, c, g, or t
  misc_feature (1027)..(1027): n is a, c, g, or t
  misc_feature (1039)..(1039): n is a, c, g, or t
  misc_feature (1060)..(1060): n is a, c, g, or t
  misc_feature (1071)..(1071): n is a, c, g, or t
  misc_feature (1089)..(1089): n is a, c, g, or t
  misc_feature (1091)..(1091): n is a, c, g, or t
  misc_feature (1097)..(1097): n is a, c, g, or t
  misc_feature (1100)..(1100): n is a, c, g, or t
  misc_feature (1106)..(1106): n is a, c, g, or t
  misc_feature (1111)..(1111): n is a, c, g, or t
  misc_feature (1117)..(1117): n is a, c, g, or t
  misc_feature (1134)..(1134): n is a, c, g, or t
  misc_feature (1140)..(1140): n is a, c, g, or t
  misc_feature (1149)..(1149): n is a, c, g, or t
  misc_feature (1155)..(1155): n is a, c, g, or t
  misc_feature (1157)..(1157): n is a, c, g, or t
  misc_feature (1159)..(1159): n is a, c, g, or t
  misc_feature (1168)..(1168): n is a, c, g, or t
  misc_feature (1177)..(1180): n is a, c, g, or t
tagagaaattactatgagaggatcgcatcaccatcaccattcacggatcctatttaggtgacactatagaatcgtcgacccacgcgtccgctgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaangantttgtgcantttgtgtgctcggatggntcgggccaggccaccggaaagcccaacggtancggncaagggcaaaattcccgggggtcatttttgctaccgccncccccctccannggccaaacntgngcccntcctatgctgaatnccaantccccaannantgnccccaaaagggnccccttgaatcctccatcacnttattccaaanaaaggggccctcctttgncnaacggnttngttaanatcgnaacccngggaagggaaatttttnaaaatncccaaaaanttccantncnggttccccngaaaaaatnnnna

SEQ ID NO: 24 - DNA, 1006 bp, Human
  misc_feature (745)..(745): n is a, c, g, or t
  misc_feature (824)..(824): n is a, c, g, or t
  misc_feature (879)..(879): n is a, c, g, or t
  misc_feature (893)..(893): n is a, c, g, or t
  misc_feature (901)..(901): n is a, c, g, or t
  misc_feature (904)..(904): n is a, c, g, or t
  misc_feature (908)..(908): n is a, c, g, or t
  misc_feature (911)..(911): n is a, c, g, or t
  misc_feature (928)..(928): n is a, c, g, or t
  misc_feature (946)..(946): n is a, c, g, or t
  misc_feature (953)..(953): n is a, c, g, or t
  misc_feature (966)..(966): n is a, c, g, or t
  misc_feature (973)..(973): n is a, c, g, or t
  misc_feature (978)..(978): n is a, c, g, or t
  misc_feature (981)..(981): n is a, c, g, or t
  misc_feature (983)..(983): n is a, c, g, or t
  misc_feature (985)..(985): n is a, c, g, or t
  misc_feature (988)..(988): n is a, c, g, or t
  misc_feature (1001)..(1001): n is a, c, g, or t
attagagaaattactatgagaggatcgcatcaccatcaccatcacggatcctatttaggtgacactatagaatcgtcgacccacgcgtccgccacgccaggcgcctgcctctccccacagcacagccaggatggggcctggagaaggccggcagcagcagaggagaccctgggagtcagggatggacaccaggcctgcagggacttcttggaactagcagagatacacagtcggaaatggcagcgggcactgcagtatgagcaggagcagcgcgtgcacttggaggaaaccattgagcagctggcgaagcagcacaacagcctcgagcgggccttccacagtgcccctggccggccggccaacccctccaagagcttcattgagggaagcctcttgactcccaaaggagaggacagtgaggaagatgaagataccgagtactttgatgccatggaagactccacatccttcatcaccgtgatcaccgaggccaaggaagacagcagaaaagctgaaggtagcaccgggacaagttccgtggactggagctcagcagacaatgtactagatggtgcctcgctcgtgcccaagggttcatccaaagtcaagaggcgagtccgcattcccaacaagcccaactacagccttaacctctggagcatcatgaagaactgcatcggccgggagctctccaggatccccatgccggtgaacttcaatgagcccctgtccatgctccagcggntgacagaggacctggagtaccaccacctgctggacaaggcagtgcactgcaccagctcagtggagcaaatgtgcctggnggccgccttctctgtgtcctcctactccaccacagtgcaccgcatcgccaagccnttcaacccccatgntggggganacnttcnagntggaccgcctcgacaanatgggcctgccctccctntgtgagnaggggagcccccnccccccntcagntgngnantangtgttttccaaanaatgg

SEQ ID NO: 25 - DNA, 1138 bp, Human
  misc_feature (2)..(2): n is a, c, g, or t
  misc_feature (880)..(880): n is a, c, g, or t
  misc_feature (922)..(922): n is a, c, g, or t
  misc_feature (947)..(947): n is a, c, g, or t
  misc_feature (979)..(979): n is a, c, g, or t
  misc_feature (988)..(988): n is a, c, g, or t
  misc_feature (996)..(996): n is a, c, g, or t
  misc_feature (1023)..(1023): n is a, c, g, or t
  misc_feature (1032)..(1032): n is a, c, g, or t
  misc_feature (1038)..(1038): n is a, c, g, or t
  misc_feature (1041)..(1041): n is a, c, g, or t
  misc_feature (1050)..(1050): n is a, c, g, or t
  misc_feature (1052)..(1054): n is a, c, g, or t
  misc_feature (1059)..(1059): n is a, c, g, or t
  misc_feature (1073)..(1074): n is a, c, g, or t
  misc_feature (1082)..(1082): n is a, c, g, or t
  misc_feature (1084)..(1084): n is a, c, g, or t
  misc_feature (1087)..(1088): n is a, c, g, or t
  misc_feature (1090)..(1090): n is a, c, g, or t
  misc_feature (1093)..(1093): n is a, c, g, or t
  misc_feature (1110)..(1110): n is a, c, g, or t
  misc_feature (1112)..(1112): n is a, c, g, or t
  misc_feature (1115)..(1115): n is a, c, g, or t
  misc_feature (1126)..(1126): n is a, c, g, or t
  misc_feature (1128)..(1128): n is a, c, g, or t
anttagagaaattactatgagaggatcgcatcaccatcaccatcacggatcctatttaggtgacactatagaatcgtcgacccacgcgtccgggtctacaccgacttcgacggcacccgagtgtacagccccccggagtggatccgctaccaccgctaccacgggcgctcggccaccgtgtggtcgctgggcgtgcttctctacgatatggtgtgtggggacatccccttcgagcaggacgaggagatcctccgaggccgcctgctcttccggaggagggtctctccagagtgccagcagctgatccggtggtgcctgtccctgcggccctcagagcggccgtcgctggatcagattgcggcccatccctggatgctgggggctgacgggggcgccccggagagctgtgacctgcggctgtgcaccctcgaccctgatgacgtggccagcaccacgtccagcagcgagagcttgtgaggagctgcacctgactgggagctaggggaccacctgccttggccagacctgggacgcccccagaccctgactttttcctgcgtgggccgtctcctcctgcggaagcagtgacctctgacccctggtgaccttcgctttgagtgccttttgaacgctggtcccgcgggacttggttttctcaagctctgtctgtccaaagacgctccggtcgaggtcccgcctgccctgggtggatacttgaaccccagacgcccctctgtgctgctgtgtccggaggcggccttcccatctgcctgcccacccggagctctttccgccggcgcagggtcccaagcccacctcccgccctcagtcctgcggtgtgcgtctgggcacgtcctgcacacacaatgcaagtcctggnctccgcgcccgcccgcccaagcgagccgtacccgccgccaantctgttatttatggtgtgacccccntggaggtgcccttcggcccacgggggctattnattgttaanttaattgntgaggttatttcctctgaacaatctgnctttccaanccccanggnaaaatgggnannnaaggnaagggggtggcttnngtccaagnanccnngnccntaattcttggctgggtntntcntggcccccctntnaaaaaaaaaa

SEQ ID NO: 26 - DNA, 1212 bp, Human
  misc_feature (846)..(846): n is a, c, g, or t
  misc_feature (849)..(849): n is a, c, g, or t
  misc_feature (893)..(893): n is a, c, g, or t
  misc_feature (918)..(918): n is a, c, g, or t
  misc_feature (933)..(933): n is a, c, g, or t
  misc_feature (938)..(938): n is a, c, g, or t
  misc_feature (941)..(941): n is a, c, g, or t
  misc_feature (957)..(957): n is a, c, g, or t
  misc_feature (961)..(961): n is a, c, g, or t
  misc_feature (964)..(964): n is a, c, g, or t
  misc_feature (978)..(978): n is a, c, g, or t
  misc_feature (983)..(983): n is a, c, g, or t
  misc_feature (1002)..(1002): n is a, c, g, or t
  misc_feature (1017)..(1017): n is a, c, g, or t
  misc_feature (1042)..(1042): n is a, c, g, or t
  misc_feature (1051)..(1051): n is a, c, g, or t
  misc_feature (1070)..(1070): n is a, c, g, or t
  misc_feature (1075)..(1075): n is a, c, g, or t
  misc_feature (1078)..(1078): n is a, c, g, or t
  misc_feature (1082)..(1082): n is a, c, g, or t
  misc_feature (1097)..(1097): n is a, c, g, or t
  misc_feature (1101)..(1102): n is a, c, g, or t
  misc_feature (1108)..(1108): n is a, c, g, or t
  misc_feature (1116)..(1116): n is a, c, g, or t
  misc_feature (1121)..(1121): n is a, c, g, or t
  misc_feature (1124)..(1124): n is a, c, g, or t
  misc_feature (1128)..(1129): n is a, c, g, or t
  misc_feature (1131)..(1131): n is a, c, g, or t
  misc_feature (1134)..(1134): n is a, c, g, or t
  misc_feature (1137)..(1137): n is a, c, g, or t
  misc_feature (1144)..(1144): n is a, c, g, or t
  misc_feature (1147)..(1147): n is a, c, g, or t
  misc_feature (1152)..(1152): n is a, c, g, or t
  misc_feature (1156)..(1156): n is a, c, g, or t
  misc_feature (1165)..(1165): n is a, c, g, or t
  misc_feature (1168)..(1168): n is a, c, g, or t
  misc_feature (1173)..(1173): n is a, c, g, or t
  misc_feature (1177)..(1177): n is a, c, g, or t
  misc_feature (1185)..(1185): n is a, c, g, or t
  misc_feature (1195)..(1195): n is a, c, g, or t
  misc_feature (1202)..(1202): n is a, c, g, or t
  misc_feature (1205)..(1205): n is a, c, g, or t
gagaaattactatgagaggatcgcatcaccatcaccatcacggatcctatttaggtgacactatagaatcgtcgacccacgcgtccgagcatgtgctccgggaaaaccaggattatgtccctggagagcggaccccaatgctggaggatgtagatgaggggggcatccggccctggcacctggtgaagccaagtgatgagccggagccgcccaggcctcggaggggcagccttcggggcggggagcgtgagcgcgccaaggccatccctgagatctacctgacccgcctgctgtccatgaagggcaccctgcagaagttcgtggatgacctgttccaggtgattctcagcaccagccgccccgtgccgctcgctgtgaagtacttctttgacctgctggatgagcaggcccagcagcatggcatctccgaccaggacaccatccacatctggaagaccaacagcttgcctctgaggttctggatcaatataataaaaaacccgcagtttgtgttcgacgtgcaaacatctgataacatggatgcggtgctccttgtcattgcacagaccttcatggacgcctgcaccctggccgaccacaagctgggccgggactccccgatcaacaaacttctgtatgcacgggacattccccggtacaagcggatggtggaaaggtactatgcagacatcagacagactgtcccagccagcgaccaagagatgaactctgtcctggctgaactgtcctggaactactccggagacctcggggcgcgagtggccctgcatgaactctacaagtacatcaacaagtactatgaccagatcatcactgccctggagnagnatggcacggcccaaaaaatgcagctgggctatcggctccagcanattgcagctgctgtggaaaacaagntcacagatctatagnaaccnagnagcccggcctgctgtngctncancctggcctgggcancctgnaactcgaagaaaagccccntcttaggtgctgtantgactgacaacaaaattatggaagngactcccantctctggggcttggctcgncctgntgnatcnctctaaaccgggccnaggnnatgggnaataccanctgtnccnatcnngnacntgnaacggtntgnggatngganaaggcttcnaanggggnaaantccgcccnggaaattatnttctaantgnctgcccc

SEQ ID NO: 27 - DNA, 636 bp, Human
  misc_feature (5)..(5): n is a, c, g, or t
  misc_feature (34)..(34): n is a, c, g, or t
  misc_feature (37)..(37): n is a, c, g, or t
  misc_feature (40)..(40): n is a, c, g, or t
  misc_feature (45)..(45): n is a, c, g, or t
  misc_feature (67)..(67): n is a, c, g, or t
gaatntaaaaattatttgctttgtgagcggatanatntangattnattgtgagcggataacaatttncacagaattattaaagaggagaaattaactatgagaggatcgcatcaccatcaccatcacggatcctatttaggtgacactatagaatcgtcgacccacgcgtccgcccacgcgtccgcccacgcgtccgaaaggcatgaggggtcgtcttcggaatctgtgccacccggcactaccatttcgagggtgaagctcctcgacaccatggtggacacttttcttcagaagctggtcgccgccggcagctaccagagattcactgactgctataagtgcttctaccagttgcagcctgcgatgacacagcaaatctatgacaagtttatagctcagttgcagacatctatccgggaggaaatctctgacatcaaagaggaggggaacctagaagctgtcttgaatgccttggataaaattgtggaagaaggcaaagtccgcaaagagccagcctggcgccccagcgggatcccagagaaggatctgcacagtgttatggcaccctacttcctgcagcaacgggacaccctgcggcgccatgtgcagaaacagggaggccgagaaccagcagc

SEQ ID NO: 28 - DNA, 1114 bp, Human
  misc_feature (1)..(1): n is a, c, g, or t
  misc_feature (5)..(5): n is a, c, g, or t
  misc_feature (912)..(912): n is a, c, g, or t
  misc_feature (918)..(918): n is a, c, g, or t
  misc_feature (947)..(947): n is a, c, g, or t
  misc_feature (955)..(955): n is a, c, g, or t
  misc_feature (957)..(957): n is a, c, g, or t
  misc_feature (970)..(971): n is a, c, g, or t
  misc_feature (974)..(975): n is a, c, g, or t
  misc_feature (978)..(978): n is a, c, g, or t
  misc_feature (987)..(987): n is a, c, g, or t
  misc_feature (998)..(998): n is a, c, g, or t
  misc_feature (1034)..(1034): n is a, c, g, or t
  misc_feature (1044)..(1044): n is a, c, g, or t
  misc_feature (1058)..(1059): n is a, c, g, or t
  misc_feature (1070)..(1070): n is a, c, g, or t
  misc_feature (1080)..(1080): n is a, c, g, or t
  misc_feature (1095)..(1097): n is a, c, g, or t
  misc_feature (1102)..(1102): n is a, c, g, or t
  misc_feature (1108)..(1108): n is a, c, g, or t
  misc_feature (1110)..(1110): n is a, c, g, or t
naatngagaaaattactatgagaggatcgcatcaccatcaccatcacggatcctatttaggtgacactatagaatcgtcgacccacgcgtccgcgagcaagatggccaccaccaagcgcgtcttgtacgtgggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaangcctanatgtcttgcggcaaatttgagaaaacagnaagagtcnancaattaccacccnnccnnagntcctggaanctgacgtaaanctcgtgccgacggcaaaacctgccggccgtgggaanccgtggaacntcctctgcagggannaaaagggccanggtctttttntgggggttcccactnnngggcncctacntntggg

SEQ ID NO: 29 - DNA, 937 bp, Human
catcaccatcaccatcacggatcctatttaggtgacactatagaatcgtcgacccacgcgtccggctccttcagcatctcttcgaacctccagcggcacgtccggaacatccacaacaaggagaagcctttcaagtgccacctgtgcaaccgctgcttcgggcagcagaccaacctggaccggcacctcaagaagcacgagcacgagaacgcaccagtgagccagcaccccggggtcctcacgaaccacctggggaccagcgcgtcctctcccacctcagagtcggacaaccacgcacttttagacgagaaagaagactcttatttctcggaaatcagaaactttattgccaatagtgagatgaaccaagcatcaacgcgaacagagaaacgggcggacatgcagatcgtggacggcagtgcccagtgtccaggcctagccagtgagaagcaggaggacgtggaggaggaggacgacgatgacctggaggaggacgatgaggacagcctggccgggaagtcgcaggatgataccgtgtcccccgcacccgagccccaggccgcctacgaggatgaggaggatgaggagccagccgcctccctggccgtgggctttgaccacacccgaaggtgtgctgaggaccacgaaggcggtctgttagctttggagccgatgccgacttttgggaaggggctggacctccgcagagcagctgaggaagcatttgaagttaaagatgtgcttaattccaccttagattctgaggctttaaaacatacactgtgcaggcaggctaagaaccaggcatatgcaatgatgctgtccctttccgaagacactcctctccacaccccctcccagggttctctggacgcttggttgaaggtcactggagccacgtcggagtctggagcatttcaccccatcaaccacctct

SEQ ID NO: 30 - DNA, 1393 bp, Human
  misc_feature (4)..(8): n is a, c, g, or t
  misc_feature (1152)..(1152): n is a, c, g, or t
  misc_feature (1182)..(1182): n is a, c, g, or t
  misc_feature (1203)..(1203): n is a, c, g, or t
  misc_feature (1223)..(1223): n is a, c, g, or t
  misc_feature (1241)..(1242): n is a, c, g, or t
  misc_feature (1272)..(1272): n is a, c, g, or t
  misc_feature (1287)..(1287): n is a, c, g, or t
  misc_feature (1344)..(1344): n is a, c, g, or t
  misc_feature (1369)..(1369): n is a, c, g, or t
  misc_feature (1375)..(1375): n is a, c, g, or t
  misc_feature (1386)..(1386): n is a, c, g, or t
aacnnnnnctaagagatactagagaggatgcatcaccatcaccatcacggtcgacccacgcgtccggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgtggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcaatgtcggaaggccagctttgacctctatggcgctgacttcgtgttcggggaggacttccagccctggctgattgagatcacgccagcccccgatggcaccctccacacagtcactgcccggctctgtgctggcgggcaactgaaaccttgcccggggctttacaccaagccgccccccaatgtgacacagagcctttgacctctctataaacacctgctttgcaggtcctcattaggcgcattcctttcctgaagagagcttccccaaaaacccttctgtatgtttcctccgagagagccctcctcnccccccctccccaggactccctgcacaaanaaccccgcctatccctccgcntcctttctctctctccaacntacttcctcccctcaccnnccaggcccccacacaaaccaccatttggtntacccctcatccctntctcttctcccccccatatttcttctctccccctccctgtccctcccccttcctaancttacttgccctcatttcaaatccngcaacntccccgcaacntcctcta

SEQ ID NO: 31 - DNA, 946 bp, Human
catcaccatcaccatcacggatcctatttaggtgacactatagaatcgtcgacccacgcgtccgccaaagaagattctaaacttatagctctcatatggcccagtgagtggcaaatgatacaaaagctctttgttgtggatcatgtaattaaaatcacgagaattgaagtgggagatgtaaacccttcagaaacacagtatatttctgagcccaaactctgtccagaatgcagagaaggcttattgtgtcagcagcagagggacctgcgtgaatacactcaagccaccatctatgtccataaagttgtggataataaaaaggtgatgaaggattcggctccggaactgaatgtgagtagttctgaaacagaggaggacaaggaagaagctaaaccagatggagaaaaagatccagattttaatcaaagcaatggtggaacaaagcggcaaaagatatcccatcaaaattatatagcctatcaaaagcaagttattcgccgaagtatgcgacatagaaaagttcgtggtgagaaagcacttctcgtttctgctaatcagacgttaaaagaattgaaaattcagatcatgcatgcattttcagttgctccttttgaccagaatttgtcaattgatggaaagattttaagtgatgactgtgccaccctaggcacccttggcgtcattcctgaatctgtcattttattgaaggctgatgaaccaattgcagattatgctgcaatggatgatgtcatgcaagtttgtatgccagaagaagggtttaaaggtactggtcttcttggacattaatctttgaatacttgctgactgctaagaaatgaccagaggggaagaggagtttgacatgttagggcattaaagcaaaggtggatttagaattaaccattacatgccccttccaaaggcagaatccattcaacgtgactgt

SEQ ID NO: 32 - DNA, 1125 bp, Human
  misc_feature (232)..(232): n is a, c, g, or t
  misc_feature (475)..(475): n is a, c, g, or t
  misc_feature (553)..(553): n is a, c, g, or t
  misc_feature (596)..(596): n is a, c, g, or t
  misc_feature (608)..(608): n is a, c, g, or t
  misc_feature (635)..(635): n is a, c, g, or t
  misc_feature (649)..(649): n is a, c, g, or t
  misc_feature (657)..(657): n is a, c, g, or t
  misc_feature (715)..(715): n is a, c, g, or t
  misc_feature (730)..(730): n is a, c, g, or t
  misc_feature (735)..(735): n is a, c, g, or t
  misc_feature (747)..(747): n is a, c, g, or t
  misc_feature (752)..(752): n is a, c, g, or t
  misc_feature (765)..(766): n is a, c, g, or t
  misc_feature (779)..(779): n is a, c, g, or t
  misc_feature (787)..(788): n is a, c, g, or t
  misc_feature (827)..(828): n is a, c, g, or t
  misc_feature (843)..(843): n is a, c, g, or t
  misc_feature (845)..(845): n is a, c, g, or t
  misc_feature (861)..(861): n is a, c, g, or t
  misc_feature (882)..(882): n is a, c, g, or t
  misc_feature (886)..(886): n is a, c, g, or t
  misc_feature (889)..(889): n is a, c, g, or t
  misc_feature (899)..(900): n is a, c, g, or t
  misc_feature (908)..(909): n is a, c, g, or t
  misc_feature (911)..(913): n is a, c, g, or t
  misc_feature (929)..(929): n is a, c, g, or t
  misc_feature (933)..(933): n is a, c, g, or t
  misc_feature (942)..(942): n is a, c, g, or t
  misc_feature (948)..(948): n is a, c, g, or t
  misc_feature (956)..(957): n is a, c, g, or t
  misc_feature (970)..(970): n is a, c, g, or t
  misc_feature (976)..(976): n is a, c, g, or t
  misc_feature (985)..(986): n is a, c, g, or t
  misc_feature (991)..(991): n is a, c, g, or t
  misc_feature (1001)..(1001): n is a, c, g, or t
  misc_feature (1006)..(1006): n is a, c, g, or t
  misc_feature (1008)..(1008): n is a, c, g, or t
  misc_feature (1016)..(1016): n is a, c, g, or t
  misc_feature (1024)..(1024): n is a, c, g, or t
  misc_feature (1032)..(1032): n is a, c, g, or t
  misc_feature (1041)..(1042): n is a, c, g, or t
  misc_feature (1049)..(1050): n is a, c, g, or t
  misc_feature (1052)..(1052): n is a, c, g, or t
  misc_feature (1054)..(1054): n is a, c, g, or t
  misc_feature (1065)..(1065): n is a, c, g, or t
  misc_feature (1067)..(1067): n is a, c, g, or t
  misc_feature (1075)..(1075): n is a, c, g, or t
  misc_feature (1078)..(1078): n is a, c, g, or t
  misc_feature (1090)..(1090): n is a, c, g, or t
  misc_feature (1094)..(1094): n is a, c, g, or t
  misc_feature (1104)..(1105): n is a, c, g, or t
  misc_feature (1116)..(1117): n is a, c, g, or t
gaatagagagattactatgagaggatcgcatcaccatcaccatcacggatcctatttaggtgacactatagaatcgtcgacccacgcgtccgggtttggttgtgagatcgagaataacagaagcagcggagcattctggaaatattactatgatggaaaggactacattgaattcaacaaagaaatcccagcctgggtccccttcgacccagcagcccagataaccaagcanaagtgggaggcagaaccagtctacgtgcagcgggccaaggcttacctggaggaggagtgccctgcgactctgcggaaatacctgaaatacagcaaaaatatcctggaccggcaagatcctccctctgtggtggtcaccagccaccaggccccaggagaaaagaagaaactgaagtgcctggcctacgacttctacccagggaaaattgatgtgcactggactcgggccggcgaggtgcaggancctgagttacggggagatgttcttcacaatggaaatggcacttaccagtcctgggtggtggtggcagtgcccccgcangacacagccccctactcctgccacgtgcagcacagcagcctgncccagcccctcntggtgccctgggaggccagctaggaancaagggttggaggnaatgtggnatctcaaacccagtaagctgcccttcctgcctgatgtgggagctgaaccacagaaatncacatgtcaatgganccacnaggccctgaagnagcantgtgggggggacnnaacaggaggttgnatttggannaccgaaagactgggatgcctgtcttgaagtataacttgnnacccaaaaaaaatcntntcacccttgagccccncccccaccccccttggtctantctngtnagaagctaannaaaataanncnnnccctcctttccctaancaanaaaaatgantaatanactaaaannttattttctactnagggcnggccccccnnccatnaaggagtccncaatnanatcttaantcaccttnatctttgncaccctgtnnaaaaaanncncnaaattgactcncnaacctccnttncgaattgttttnaaanactctcgttnngccccggcgtnnattttttt

SEQ ID NO: 33 - DNA, 856 bp, Human
  misc_feature (427)..(427): n is a, c, g, or t
  misc_feature (533)..(533): n is a, c, g, or t
  misc_feature (584)..(584): n is a, c, g, or t
  misc_feature (666)..(666): n is a, c, g, or t
  misc_feature (670)..(670): n is a, c, g, or t
  misc_feature (684)..(684): n is a, c, g, or t
  misc_feature (725)..(725): n is a, c, g, or t
  misc_feature (745)..(745): n is a, c, g, or t
  misc_feature (752)..(752): n is a, c, g, or t
  misc_feature (765)..(765): n is a, c, g, or t
  misc_feature (770)..(770): n is a, c, g, or t
  misc_feature (776)..(776): n is a, c, g, or t
  misc_feature (787)..(787): n is a, c, g, or t
  misc_feature (789)..(789): n is a, c, g, or t
  misc_feature (797)..(797): n is a, c, g, or t
  misc_feature (800)..(801): n is a, c, g, or t
  misc_feature (808)..(808): n is a, c, g, or t
  misc_feature (811)..(811): n is a, c, g, or t
  misc_feature (813)..(813): n is a, c, g, or t
  misc_feature (817)..(817): n is a, c, g, or t
  misc_feature (829)..(831): n is a, c, g, or t
  misc_feature (834)..(834): n is a, c, g, or t
  misc_feature (847)..(847): n is a, c, g, or t
  misc_feature (849)..(849): n is a, c, g, or t
  misc_feature (855)..(855): n is a, c, g, or t
tagagagattactatgagaggatcgcatcaccatcaccatcacggatcctatttaggtgacactatagaatcgtcgacccacgcgtccgccggaccgggacgcagagtctgcggacccggcgccgaggcggccacccgagacgcggcgcgcacgctccggcctgcgcccggcccggccatggcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgcccccggaagactttcccctgcctccacctccccttgctggggatggcgangatgcatagggtgctctgggaggtgccttcccgccgccccctcccccgatcgaggaatcatttccccctgcgcctctggaggaggagatcttcccttccccgccgnctcctccggaggaggagggagggcctgaggcccccataccgcccccaccanagcccagggagaaggtgagcagtattgatttggagatcgactctctgtcctcactgctggatgacatgaccaagaatgatcntttnaaagcccgggtgtnatctggatatgtgcccccaccagtggccacttccatttcanttccaagtccagtaccaaancctgcanccgggggcaaaanacccntgcctnctttggaagtncnctttcagnttnncagcctntgncnaaantttcggccttcnnnctnaaagccaaaaaanantttccnt

SEQ ID NO: 34 - DNA, 972 bp, Human
tgagaggtcgcatcaccatcaccatcacggatcctatttaggtgacactatagaatcgtcgacccacgcgtccgccgaaattgacggacaagtcttcgactacgtgaccggcgtcttgcacagcggcagcgcggacttcgagtctgtggatgacctggtggaagctgtaggggaactattgcaagaggtgtccggggacagcaaggatgacgcgggcatcagggccgtgtgccagcgcatgtacaacactctgcgtctggctgagccacaaagccagggaaatagccaggtgctactggacgcccctatccagttgtcaaagataacggagaactacgactgtggaaccaaacttccaggactgctaaagagggaacagtcctcgacagtgaatgcaaagaagttagagaaggccgaggctcgacttaaggcaaagcaggagaagcgctcagagaaggacacgctcaagaccagcaaccctctagtcttagaagaggcatcagccagccaggcaggcagcagaaaggagagtcggttggaatcatctggcaagaacaaatcctatgatgtgcgaattgagaactttgatgtgtcttttggcgatagagtactgctggctggagcggatgtgaacctggcatggggccgccgttacgggctggtggggcggaatgggttggggaagacaacgttactgaagatgctggccacccggagtctgcgggttccagcccacatttccctgctgcacgttgagcaagaggttgctggagatgacactcctgccctgcagagtgtgctggagagtgacagtgtgcgagaggatttgctacggagggagcgggagctcactgcccagattgctgctggcagggcggagggctctgaagctgcagagctggcagaaatctatgccaaactggaggagattgaggctgacaggcacctgccagggcatcagtcattctcgct

SEQ ID NO: 35 - DNA, 829 bp, Human
  misc_feature (757)..(757): n is a, c, g, or t
  misc_feature (774)..(774): n is a, c, g, or t
  misc_feature (777)..(777): n is a, c, g, or t
  misc_feature (802)..(802): n is a, c, g, or t
  misc_feature (821)..(821): n is a, c, g, or t
  misc_feature (824)..(824): n is a, c, g, or t
ttaactatgagaggatcgcatcaccatcaccatcacggatcctatttaggtgacactatagaatcgtcgacccacgcgtccgcccacgcgtccggcgaggaggagctttgcctagcttgcaggcagcgcagggcagacggcggcaggagaagcaagatgaatgcaggctcagatcctgtggtcatcgtctcggcggcgcggaccatcataggttccttcaatggtgccttagctgctgttcctgtccaggacctgggctccactgtcatcaaagaagtcttgaagagggccactgtggctccggaagatgtgtctgaggtcatctttggacatgtcttggcagcaggctgtgggcagaatcctgttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggctcctcacttggcttacttgagaacaggagtaaagataggtgagatgccactgactgacagtatactctgtgatggtcttacagatgcatttcacaactgtcatatgggtattacagctgaaaatgtagccaaaaaatggcaagtgagtagagaagatcaggacaaggttgcagttctgtcccagaacaggacagagaatgcacagaaagctggccattttgacaaanagattgtaccagttttnggngtcaactagaaaaaggtcttattgnagttaaaacagatgagttnccncgcca

SEQ ID NO: 36 - DNA, 1061 bp, Human
  misc_feature (958)..(958): n is a, c, g, or t
  misc_feature (994)..(994): n is a, c, g, or t
  misc_feature (1033)..(1033): n is a, c, g, or t
  misc_feature (1057)..(1057): n is a, c, g, or t
tagagagaattactatgagaggatcgcatcaccatcaccatcacggatcctatttaggtgacactatagaatcgtcgacccacgcgtccgcccacgcgtccgatgtaggcaccggtccgagtgcctgccctctgtccccgcggctgggtctcgtctgctccggttcctgggctcctaattcttggtccagcttcttccaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacacgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaccgttacggtaatactttactttaggcatccctcctgttgctagcanccttttgacctatctgcatgcagtgttctcagtagnaatgttcctctgttacatggaaaaattgttgatggtgcnttgtaaattaaaaacccacttgcnaacc

SEQ ID NO: 37 - DNA, 1220 bp, Human
  misc_feature (1)..(1): n is a, c, g, or t
  misc_feature (3)..(3): n is a, c, g, or t
  misc_feature (960)..(960): n is a, c, g, or t
  misc_feature (980)..(980): n is a, c, g, or t
  misc_feature (983)..(983): n is a, c, g, or t
  misc_feature (989)..(989): n is a, c, g, or t
  misc_feature (996)..(996): n is a, c, g, or t
  misc_feature (999)..(999): n is a, c, g, or t
  misc_feature (1013)..(1013): n is a, c, g, or t
  misc_feature (1032)..(1032): n is a, c, g, or t
  misc_feature (1034)..(1034): n is a, c, g, or t
  misc_feature (1036)..(1036): n is a, c, g, or t
  misc_feature (1038)..(1038): n is a, c, g, or t
  misc_feature (1041)..(1041): n is a, c, g, or t
  misc_feature (1053)..(1053): n is a, c, g, or t
  misc_feature (1058)..(1058): n is a, c, g, or t
  misc_feature (1066)..(1066): n is a, c, g, or t
  misc_feature (1080)..(1080): n is a, c, g, or t
  misc_feature (1093)..(1093): n is a, c, g, or t
  misc_feature (1100)..(1100): n is a, c, g, or t
  misc_feature (1103)..(1103): n is a, c, g, or t
  misc_feature (1106)..(1106): n is a, c, g, or t
  misc_feature (1109)..(1109): n is a, c, g, or t
  misc_feature (1116)..(1116): n is a, c, g, or t
  misc_feature (1124)..(1125): n is a, c, g, or t
  misc_feature (1144)..(1144): n is a, c, g, or t
  misc_feature (1148)..(1148): n is a, c, g, or t
  misc_feature (1151)..(1151): n is a, c, g, or t
  misc_feature (1158)..(1158): n is a, c, g, or t
  misc_feature (1180)..(1180): n is a, c, g, or t
  misc_feature (1182)..(1184): n is a, c, g, or t
  misc_feature (1188)..(1189): n is a, c, g, or t
  misc_feature (1195)..(1195): n is a, c, g, or t
  misc_feature (1204)..(1204): n is a, c, g, or t
  misc_feature (1211)..(1211): n is a, c, g, or t
nantagagaaattactatgagaggatcgcatcaccatcaccatcacggatcctatttaggtgacactatagaatcgtcgacccacgcgtccgagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaagaagcagacaggcagcatggactccgatgacttcagggctctgcttatctccacaggatacagcctgggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtgaggccccagagacctgacccaacacccccgacggcctccaggaggggcctgggcagccccacagtcccattcctccactctgtatctatgcaaagcactctctgcagtcctccggggtgggtgggtgggcagggaggggctgggggcaggctctctcctctctctctttgtgggttggccaggaggttcccccgaccaggttggggagactgggggccagcgcttctggtctggtaaatatgtatgatgtgttgtgcttttttaaccaaggaggggccagtgggattcccacagcacaaccggtcctttccatgnccctgggatgcctcaccacnccnaggttntttttcnttngctctgaaggtccnttcaaggcctccccattcnangncnaangccccatgtgcnttgtncaaaaatngcttgggccatgcnaggggccaccaangggcccnccnccnctngaaggtngggaaccnnccagccctttcccttttgntccnaantcattgncattgcaggaaatgggcccaanannncccnnttttgnaaaaaaaantattggnaaacgggcc

SEQ ID NO: 38 - DNA, 1011 bp, Human
  misc_feature (9)..(9): n is a, c, g, or t
  misc_feature (16)..(16): n is a, c, g, or t
  misc_feature (842)..(842): n is a, c, g, or t
  misc_feature (889)..(889): n is a, c, g, or t
  misc_feature (900)..(900): n is a, c, g, or t
  misc_feature (904)..(904): n is a, c, g, or t
  misc_feature (916)..(916): n is a, c, g, or t
  misc_feature (925)..(925): n is a, c, g, or t
  misc_feature (929)..(929): n is a, c, g, or t
  misc_feature (932)..(933): n is a, c, g, or t
  misc_feature (958)..(958): n is a, c, g, or t
  misc_feature (984)..(984): n is a, c, g, or t
  misc_feature (1005)..(1005): n is a, c, g, or t
caatagagnaataacnatgagaggatcgcatcaccatcaccatcacggatcctatttaggtgacactatagaatcgtcgacccacgcgtccgtgatgtctgagcttctttttgagtgctacgggattcccaaggttgcctatggaatagacagcctcttcagcttctaccacaataagccaaagaactcgatgtgcagtgggctaatcatttcatctggataccagtgtacgcatgttttacccatcttagaagggagattagatgctaaaaactgcaagcgcatcaatcttggaggaagccaagcagctggttacctccagcgtctcctccagctgaagtaccctgggcacctggcagccatcaccctcagccgcatggaggagattctgcatgagcacagctacatcgctgaggattatgtggaagaattacacaaatggcggtgtcctgattattatgagaataacgtccacaagatgcagctcccattttccagcaagctcctgggcagcactctgacctctgaggagaaacaagaaaggcggcagcagcaattgcggcggctgcaggagctcaatgcccggcggcgggaggagaagctgcagctggatcaggagcgtctggaccgactgctatatgtgcaggaacttctagaggatggccagatggatcagtttcacaaagctctgatagagctgaatatggactccccagaagagctgcagtcctacatccagaagctcagtatagcagtggagcaggctaagcagaaaatcctccaagcggaagtcaacctcgaggtggatgtggtagacagcaagccagagacccctgacctanagcagctggagccgtctttggaagatgtggaaagcatgaatgatttngatccccttgntttncagaggaaaacncctgggagngganaannccggtcaccactggttcagcccggngtttaacttggcagcatatcatcagntatttggttgggaaaaaaaanaattcg

SEQ ID NO: 39 - DNA, 1285 bp, Human
  misc_feature (1)..(3): n is a, c, g, or t
nnnttgatatattgacttacctataaataggcgtatcacgaggccctttcgtcttcacctcgagaaatcataaaaaatttatttgctttgtgagcggataacaattataatagattcaattgtgagcggataacaatttcacacagaattcattaaagaggagaaattaactatgagaggatcgcatcaccatcaccatcacggtcgacccacgcgtccgggctcctggaacacaggagccgaatcagaaatgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccaacagaacaaattcctctcactgctctccacgtggcatctttaataaaagaggcaagggtttcctccgggagaaaggaatattggtccgggtaaagggcctaacgcaggggcacccatttcttccccatggaaaataacaagtaaccctccccggaatcacagaggtgggcagttattaaaaaacctgccggaaaaacaacctaaaaaggggacccggaacttggaagaaaacccctgctttgttatctaagcccatatggcaacgtggtgattttcaccctggggaatctccccccggcccaggtgcccactcgcacccacttcccgggcaatcccattgctacaatttctgcgccgcccctaagctgcttcacctactcatgatccctcccccctaagcgtctagcccttgcgaaccgcccaaacctacataacacacctccacagggagaa

SEQ ID NO: 40 - DNA, 1376 bp, Human
  misc_feature (7)..(8): n is a, c, g, or t
gcgtttnnccaatatactgacttacctataaataggcgtatcacgaggccctttcgtcttcacctcgagaaatcataaaaaatttatttgctttgtgagcggataacaattataatagattcaattgtgagcggataacaatttcacacagaattcattaaagaggagaaattaactatgagaggatcgcatcaccatcaccatcacggtcgacccacgcgtccggaaattagtgaaagaggcgcaggccctacatttaaagctagtccctcttgggttgacccagaaggagaaacagcagaaagcactgaagatgcacccttagactttcacagggtcctgcacaattctctgggaaacatttccatgctgccatgtagctccttcacccctaattggcctgttcaaaatcctgactccagaaaaagtggtggcccagtcgcagagcagggcatcgaccctgatgcctccacagtggatgaggaggggcaactgctcgacagcacggatgttccctgcacaaatgggcacggctctcatagactgcggccgcgatccgcatgcgagctcgattagctgagcttggactcctgttgatagatccagtaatgacctcagaactccatctggatttgttcagaacgctcggttgccgccgggcgttttttattggtgagaatccaagctagcttggcgagattttcaggagctaaagaagctaaaatggagaaaaaaatcactggatataccaccgttgatatatcccaatggcatcgtaaagaacattttgaggcatttcagtcagttgctccatgtacctataaccagaccgttcagctggatattacggcccttttaaaggaccgtaaaaaaaaataacccaagtttatccggccttaatcccattcttgcccccctgaagaatgctcctccgaatttcctatggccatgaaaaacggggaactggggaaatgggaaaagggtcccccttggtacccggtttcccagaacaaattgaacagtttcctcccctggaatgaaaaccccaaaattccggcatttttacccaatttttccaaaaatgggcggttacggaaaaccctccctatttcccaaagggtttttgaaaaattgtttctccccccccccacgccggggagtttcacactttatatttacaaggcgcaaaaggaaaatcccttccccccttttttcctgggaatatatattaccccaagaaagaagcgtacctcccggaagaaacgcccatacacctatctatgcgctatccactcccaaaattttcaactataacacgtatctgaagcgggggaggatactctatagagcattggcataacatacacgagccttcc

SEQ ID NO: 41 - DNA, 1179 bp, Human
  misc_feature (756)..(756): n is a, c, g, or t
  misc_feature (814)..(814): n is a, c, g, or t
  misc_feature (860)..(860): n is a, c, g, or t
  misc_feature (862)..(862): n is a, c, g, or t
  misc_feature (868)..(868): n is a, c, g, or t
  misc_feature (908)..(908): n is a, c, g, or t
  misc_feature (982)..(982): n is a, c, g, or t
  misc_feature (989)..(989): n is a, c, g, or t
  misc_feature (991)..(991): n is a, c, g, or t
  misc_feature (1007)..(1007): n is a, c, g, or t
  misc_feature (1015)..(1015): n is a, c, g, or t
  misc_feature (1025)..(1025): n is a, c, g, or t
  misc_feature (1036)..(1036): n is a, c, g, or t
  misc_feature (1041)..(1041): n is a, c, g, or t
  misc_feature (1050)..(1050): n is a, c, g, or t
  misc_feature (1056)..(1056): n is a, c, g, or t
  misc_feature (1060)..(1060): n is a, c, g, or t
  misc_feature (1065)..(1065): n is a, c, g, or t
  misc_feature (1081)..(1081): n is a, c, g, or t
  misc_feature (1083)..(1083): n is a, c, g, or t
  misc_feature (1088)..(1088): n is a, c, g, or t
  misc_feature (1109)..(1109): n is a, c, g, or t
  misc_feature (1113)..(1113): n is a, c, g, or t
  misc_feature (1119)..(1119): n is a, c, g, or t
  misc_feature (1136)..(1137): n is a, c, g, or t
  misc_feature (1142)..(1142): n is a, c, g, or t
  misc_feature (1165)..(1165): n is a, c, g, or t
  misc_feature (1171)..(1171): n is a, c, g, or t
  misc_feature (1174)..(1174): n is a, c, g, or t
gagagattactatgagaggatcgcatcaccatcaccatcacggatcctatttaggtgacactatagaatcgtcgacccacgcgtccgatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaanagaggctgaagtggccccacgagcaggtttgcaatggtctggagcaccaaggaagcancagcgctctgatctcaatggacctgttgacaataacaacattccananacaaanaaggtggcatcatttccaagttttgtggctgttccagggnccctgcgaaaccaaaaaacctcatcgacgggatcatctttgctgccaattacctgggggtccacccagctgctntcaaaangnaaccctttcaaaaacntcaaaatngatgcaagcncagaaggcctncaccnggttcaaangatgcnaaangcttnctaaaataaaaaaaancnaattntgaggggatgcccaaaccttnacgnaaatgnaccttttttttcccccnnaagantcaggttttaatgcaaacccccngaaccntgntggac

SEQ ID NO: 42 - DNA, 805 bp, Human
gatagagagattactatgagaggtcgcatcaccatcaccatcacggatcctatttaggtgacactatagaatcgtcgactctggaccttggctgtcactcagttagtgagagacagtggcagggcctctccagcaaaggagacctgccccaggtggagatcaccaaggccttcttcgcgaagcaagcagacgaggtcacactgcagcaggcggacgtggtcctggttctgcagcaggaggatgggtggctctatggcgagaggctccgggacggagagacgggatggttccccgaggactttgcccgcttcatcaccagccgtgtggccgtggagggcaatgtccgcaggatggagcgtctgcgggtggagacggacgtgtagccctggcgaggccagccggcggcagcacagcctgtccccaatcagcaagtggtcgtgcctggctctagagagcgtggggagctggtctcaagggcccagcatggttccctggggcttcccaagagcctgtggctgtggtgccgggctccagacacttcacggaaggaagatcacatgtccccagagaggcacccccaggcaagctcgagggggccacaccgtgtcccagggagcccagcctattcccgttggctggctgggcccctctcagctgctgggccccacctccccactgcacccaggggacaactccacctggactgatgggcacaggaggcaccaatagcgattattgggggcaatgcgaggtctcctcctatgcccttcctaccccgagtgggacagaagggcttgagtgccca

SEQ ID NO: 43 - DNA, 1178 bp, Human
  misc_feature (856)..(856): n is a, c, g, or t
  misc_feature (884)..(884): n is a, c, g, or t
  misc_feature (887)..(887): n is a, c, g, or t
  misc_feature (945)..(945): n is a, c, g, or t
  misc_feature (979)..(979): n is a, c, g, or t
  misc_feature (999)..(999): n is a, c, g, or t
  misc_feature (1030)..(1030): n is a, c, g, or t
  misc_feature (1049)..(1049): n is a, c, g, or t
  misc_feature (1055)..(1055): n is a, c, g, or t
  misc_feature (1066)..(1066): n is a, c, g, or t
  misc_feature (1068)..(1068): n is a, c, g, or t
  misc_feature (1071)..(1071): n is a, c, g, or t
  misc_feature (1073)..(1073): n is a, c, g, or t
  misc_feature (1080)..(1080): n is a, c, g, or t
  misc_feature (1099)..(1099): n is a, c, g, or t
  misc_feature (1104)..(1104): n is a, c, g, or t
  misc_feature (1113)..(1114): n is a, c, g, or t
  misc_feature (1123)..(1123): n is a, c, g, or t
  misc_feature (1125)..(1126): n is a, c, g, or t
  misc_feature (1132)..(1132): n is a, c, g, or t
  misc_feature (1137)..(1137): n is a, c, g, or t
  misc_feature (1139)..(1139): n is a, c, g, or t
  misc_feature (1142)..(1143): n is a, c, g, or t
  misc_feature (1165)..(1165): n is a, c, g, or t
  misc_feature (1167)..(1167): n is a, c, g, or t
  misc_feature (1172)..(1172): n is a, c, g, or t
  misc_feature (1176)..(1176): n is a, c, g, or t
tagagaaattactatgagaggatcgcatcaccatcaccatcacggatcctatttaggtgacactatagaatcgtcgacccacgcgtccgaagctggcggctacgggatccaggccctgggcggcatgctggtggagtccgtacacggggactttctgaacgtggtgggattcccgctgaaccacttctgcaagcagctggtgaagctctactacccgccccgcccggaggacttgcggcggagtgtcaagcacgactccatcccggccgcggacaccttcgaagacctcagtgacgtggaggggggtggctcggagcccactcagagggacgcgggcagccgcgatgagaaggccgaggcgggagaggcgggacaggccacggcagaggctgagtgtcacaggactcgggagaccctgcctccgttcccgacacgcctcctggagctgattgagggctttatgctatccaagggcctgctcaccgcttgcaaactgaaggtgttcgatttgttaaaagatgaagcaccccagaaggctgcggatattgccagcaaagtggacgcctctgcgtgtggaatggagaggcttctggacatctgtgctgccatggggctcctggagaagacagagcaaggttacagtaacacagagacagcgaacgtctacctggcatcggatggcgaatactctctgcacggcttcatcatgcacaataatgacctcacatggaacctctttacatacctggagtttgccatccgagagggaacaaaccagcaccacagggcgttggggaagaaggcggaaagatctgttccaggatgcgtactaccagagcccggagacgcggctgangttcatgcgggccatgcacggcatgacnaanctgactgcgtgccaggtggccacggccttcaatctgtcccgcttctcctccgcctgcnaatgggaggctgcaccggtgcactggcccgaaanctggcccgtgaataccctcntatgcaggtgactgtgtttgacctcccaaanttatcaagctggcccccanttccancccccgaacgnanggngngaaatcncttccaacagggatttttnaggancccctcccnnccttaactnanntctggnccgantntgnngaatggccaaaaaaaaatcccnanttttncccngg

SEQ ID NO: 44 - DNA, 1214 bp, Human
  misc_feature (191)..(191): n is a, c, g, or t
  misc_feature (814)..(814): n is a, c, g, or t
  misc_feature (843)..(843): n is a, c, g, or t
  misc_feature (881)..(881): n is a, c, g, or t
  misc_feature (886)..(886): n is a, c, g, or t
  misc_feature (933)..(933): n is a, c, g, or t
  misc_feature (966)..(966): n is a, c, g, or t
  misc_feature (988)..(988): n is a, c, g, or t
  misc_feature (1004)..(1004): n is a, c, g, or t
  misc_feature (1013)..(1013): n is a, c, g, or t
  misc_feature (1016)..(1017): n is a, c, g, or t
  misc_feature (1042)..(1043): n is a, c, g, or t
  misc_feature (1057)..(1057): n is a, c, g, or t
  misc_feature (1065)..(1065): n is a, c, g, or t
  misc_feature (1071)..(1071): n is a, c, g, or t
  misc_feature (1078)..(1078): n is a, c, g, or t
  misc_feature (1081)..(1081): n is a, c, g, or t
  misc_feature (1091)..(1091): n is a, c, g, or t
  misc_feature (1094)..(1094): n is a, c, g, or t
  misc_feature (1103)..(1103): n is a, c, g, or t
  misc_feature (1107)..(1107): n is a, c, g, or t
  misc_feature (1111)..(1111): n is a, c, g, or t
  misc_feature (1124)..(1125): n is a, c, g, or t
  misc_feature (1140)..(1140): n is a, c, g, or t
  misc_feature (1148)..(1148): n is a, c, g, or t
  misc_feature (1151)..(1151): n is a, c, g, or t
  misc_feature (1154)..(1154): n is a, c, g, or t
  misc_feature (1164)..(1164): n is a, c, g, or t
  misc_feature (1191)..(1191): n is a, c, g, or t
  misc_feature (1200)..(1200): n is a, c, g, or t
tagagaaattactatgagaggatcgcatcaccatcaccatcacggatcctatttaggtgacactatagaatcgtcgacccacgcgtccggacagggcattttctgcatccacccactgcgcatcaacctggggggcaagctgcagctggtgtgtttcgacaagacgggcaccctcactgaggacggcttanacgtgatgggggtggtgcccctgaaggggcaggcattcctgcccctggtcccagagcctcgccgcctgcctgtggggcccctgctccgagcactggccacctgccatgccctcagccggctccaggacacccccgtgggcgaccccatggacttgaagatggtggagtctactggctgggtcctggaggaagagccggctgcagactcagcatttgggacccaggtcttggcagtgatgagacctccactttgggagccccagctgcaggcaatggaggagcccccggtgccagtcagcgtcctccaccgcttccccttctcttcggctctgcagcgcatgagtgtggtggtggcgtggccaggggccactcagcccgaggcctacgtcaaaggctccccggagctggtggcagggctctgcaaccccgagacagtgcccaccgacttcgcccagatgctgcagagctatacagctgctggctaccgtgtcgtggccctggccagcaagccactgcccactgtgcccagcctggaggcagcccagcaactgacgagggacactgtggaaggagacctgagcctcctggggctgctggtcatgaggaacctactgaagccgcanacaacgccagttatccaggctctgcgaangacccgcatccgcgccgtcatggtgacaggggacaacntgcanacagcggtgactgtggcccggggctgtggcatggtggccccccagancatctgatcatcgtccacgccacccaccctgancggggtcagcctgcctctctcnatttctgccgatggantcccccaanccnngaatggggttaaggatctgaacagnntgcaagctacccgnggaaccanaacccnaatcagnacntggccccagnggncccctttgnattntggnaaaatttcccaanngttgccaaggtctgntcaggaanttnttncccatggccngaaaaaaaaaatgggggaaataaaatntttattggnggattgggaaaagc

SEQ ID NO: 45 - DNA, 877 bp, Human
  misc_feature (749)..(750): n is a, c, g, or t
  misc_feature (761)..(761): n is a, c, g, or t
  misc_feature (771)..(771): n is a, c, g, or t
gatactatgagaggtcgcatcaccatcaccatcacggatcctatttaggtgacactatagaatcgtcgactctggaccttggctgtcactcagttacagttacaaagataactggtggcagttctgtgcctaagctgacatcaccagttacaagcatatctcccattcaggcctctgagaagacagcagtgtctgacattttgaaaatgtctttgatggaagctcagattgatacaaatgtagaacatatgatagtggatcccccaaagaaggctcttgccactagcatgctcactggtgaagcaggatcattaccctccacccacatggtggtggcagggatggcgaattccactccccagcaacagaaatgtagagagtcctgctcgagtccatccactgttggctcttccctaacgacaaggaaaattgatccaccagcagtgcctgcgacaggccagttcatgcgtattcagaatgtaggccaaaagaaagctgaagagagtccagcagaaattatcatccaggctattcctcagtatgctattccttgtcactccagctccaatgtgggtggtggagcccagtgggcttcttgagctaaacaacttcactagtcaacagctggatgatgaggagacagcaatggagcaggacatagacagtagcacggaggatggaactgaacccagcccttctcagagctctgctgaacggtcctagtgtttggacacaatagtgcactttannacctgcttggntacaagtgtncagggaaacctttgtattttgatgactaaaagagcactttgcccgtactaggctgtgaccctaaacagcagtgttcaacaagatgtgctgcaggacagcttttaaa

SEQ ID NO: 46 - DNA, 856 bp, Human
  misc_feature (836)..(837): n is a, c, g, or t
cccgaacaataagaaatactagagaggatgcatcccatcaccatcacggatcctatttaggtgacactatagaatcgtcgactctggaccttggctgtcactcagttatagaggagacggattcagaagggctacagaccaaggttgttgaaaaccagacatatgatgagcgtctagagattaacgactccgaagaggttgcaagtatttatactccaaccccaagacaccaaggacttcctcgttctgcccatcttcctaacaaggctatggctgataacagcagtgatgagtgtgaagaggaaaataacaaggagaagaagaagacctcacagttgacacctcaacggggctttagtgaaaatgaggatgacgatgatgatgatgatgattcatctgaaactgattctgattctgatgatgatgatgaagagcatggagcccctctggaaggggcctatgaccctgcagactatgagcatttgccagtttctgctgaaattaaggaactcttccagtacatcagtaggtacacacctcagttgattgacctggaccacaaactgaagcctttcattcctgattttatcccagctgtcggggatattgatgcattcttaaaggtcccacgtcctgatggaaagcctgacaaccttggcctattggtattggatgaaccttctacaaagcagtcagaccctacggtgctctcactctggttaacagagaatttctagcagcacaacatcacacaacatatgaaagtaaaaagcctagaagatgcagaaaagaatcccaagcccatgacacgtggattgagacatctctgaatacanncgtctagcccctgcgatgt

SEQ ID NO: 47 - DNA, 1356 bp, Human
ccccctagagaatactatgagaggatcgcatcaccatcaccatcacggtcgacccacgcgtccggcccaggggccggcgcacgaaacctgtttggaggttatggatgataaacccaatcctgaagccctaagtgacagttcagagcgtcttttctcctttggcgtcatcgcagatgttcaatttgcagacttagaagatggctttaatttccaaggaaccaggcggcgatactacagacatagtcttcttcacttacagggtgccattgaagactggaataatgaaagcagcatgccctgttgtgtccttcagcttggagatatcatcgatggatataatgcacagtataatgcatccaaaaagtccctagaacttgttatggacatgttcaagaggcttaaagttccagttcatcatacatggggaaaccatgaattctataacttcagtagagagtatttaacacactctaaacttaacactaagtttctagaagatcagattgtacatcatcctgagaccatgccttcagaagattattatgcttatcattttgtaccattccctaaattccagttcattttacttgatgcatatgacttgagtgccttgggcgtgaatcaatcttctcccaaatacaagcagtgtatgaaaatattgagggagcccaatcccaatacgggaattgaatagccctcaggaattttctaaaccccatttgtccccgtttaatggagggttccccccaaaaaacgttaaccgggttgaaaggaaggggtaaaatttcctggaaccaaaccaaaaaaaggggggggttggggaacccttttttccctttttcccgagaccctttgaaaaaggggggccgggcccgggaaacaacaaaaaagcccccgggaaactttttgccccctaaaaagggggggggggattctcttttgcacgacccaccccctatggggtgcatacccacaagaccaatccccttcgcccaacatacccacccaaacacacgcgctttctccaccctaccctcaacccacacccaccctccagacccttgactacctacctcacactaacacctcctatacaaaacaacaacacatactccttccctcccatctctacctgcacaccacccctacgacccttctactctcctctccaatcaactccaccttcattcattaccactcacactcaacccacaaccatttcttatcacctcactcttccattctcttagcaacactacacaacccactcatcgcccctccatcactcacccacataacccaccaccatctaatcactcactccaaaaacctgatccacaccatccttcaccctcc

SEQ ID NO: 48 - DNA, 1167 bp, Human
  misc_feature (171)..(171): n is a, c, g, or t
  misc_feature (618)..(618): n is a, c, g, or t
  misc_feature (731)..(731): n is a, c, g, or t
  misc_feature (812)..(812): n is a, c, g, or t
  misc_feature (824)..(824): n is a, c, g, or t
  misc_feature (827)..(827): n is a, c, g, or t
  misc_feature (861)..(861): n is a, c, g, or t
  misc_feature (868)..(868): n is a, c, g, or t
  misc_feature (881)..(881): n is a, c, g, or t
  misc_feature (890)..(890): n is a, c, g, or t
  misc_feature (902)..(902): n is a, c, g, or t
  misc_feature (926)..(926): n is a, c, g, or t
  misc_feature (933)..(933): n is a, c, g, or t
  misc_feature (946)..(946): n is a, c, g, or t
  misc_feature (978)..(978): n is a, c, g, or t
  misc_feature (1014)..(1014): n is a, c, g, or t
  misc_feature (1016)..(1016): n is a, c, g, or t
  misc_feature (1023)..(1023): n is a, c, g, or t
  misc_feature (1028)..(1028): n is a, c, g, or t
  misc_feature (1036)..(1036): n is a, c, g, or t
  misc_feature (1042)..(1042): n is a, c, g, or t
  misc_feature (1058)..(1058): n is a, c, g, or t
  misc_feature (1060)..(1061): n is a, c, g, or t
  misc_feature (1071)..(1072): n is a, c, g, or t
  misc_feature (1079)..(1079): n is a, c, g, or t
  misc_feature (1090)..(1090): n is a, c, g, or t
  misc_feature (1092)..(1092): n is a, c, g, or t
  misc_feature (1103)..(1103): n is a, c, g, or t
  misc_feature (1118)..(1118): n is a, c, g, or t
  misc_feature (1140)..(1142): n is a, c, g, or t
  misc_feature (1148)..(1148): n is a, c, g, or t
  misc_feature (1151)..(1151): n is a, c, g, or t
  misc_feature (1157)..(1157): n is a, c, g, or t
  misc_feature (1159)..(1159): n is a, c, g, or t
  misc_feature (1166)..(1167): n is a, c, g, or t
tagagaaattaactatgagaggatcgcatcaccatcaccatcacggatcctatttaggtgacactatagaatcgtcgacccacgcgtccgcggacgcgtgggcggacgcgtgggcggacgcgtgggcggacgcgtgggcggacgcgtgggcggagcgtgggcgccgcgcanaggcgggcgacgcggtagtggcgaagccgggagtgtgggcgcggctggggtcctgggcccgcgcgctgctccgggactacgccgaggcctgcagggacgcttcggcggaggctagggcccggccggggcgcgccgctgtgtatgtgggtctgctgggcggcgcggcggcctgcttcacgctggcgcccagcgagggtgccttcgaggaggcgctgttggaggcgtcggggaccctcctgctgctggcgccggccacccgcaaccgcgagtccgaagccttcgtgcagaggctgctctggctgcggggccgtggccgcctgcgctacgtcaacctggggctctgctcgctggtgtacgaggcgcccttcgacgcccaggccagcctctaccaggcgcgttgccgctacctgcagccccgctggaccgacttccccggccgggtcctgnacgtgggcttcgtgggtcgctggtgggtgctgggggcctggatgcgcgactgcgacatcaacgacgacgaattcctgcacctgccggcgcatttgcgggtggtcgggccccancagctgcattccgagaccaacgagcggctcttcgatgaaaagtacaagcctgtcgtgctcaccgacgatcaggtggaccangcgctgtgggangancaggtcttgcaaaaggaaaaaaaggacaggctcnccctganccaagcccactcnctggtgcangcggaagccccnaaataaaacctgaagccccccaantcttggnaaaactgcttgcntggggtggtgcaatttttaaatgtgcctcacntgcaaaaaaacttaaaaaaaaattaatgtgcaaaantntttttcncactngaattttncacaantttggggaaacttttntnncccccccgtnnttttttnttttattaacntnaaactaaattnaaaaacccccttggnttcccggaaattttgggaaaannnaaaaanaantttaananttttttnn

SEQ ID NO: 49 - DNA, 962 bp, Human
  misc_feature (2)..(2): n is a, c, g, or t
  misc_feature (5)..(6): n is a, c, g, or t
  misc_feature (853)..(853): n is a, c, g, or t
  misc_feature (860)..(860): n is a, c, g, or t
  misc_feature (882)..(882): n is a, c, g, or t
  misc_feature (888)..(888): n is a, c, g, or t
  misc_feature (900)..(900): n is a, c, g, or t
  misc_feature (904)..(904): n is a, c, g, or t
  misc_feature (909)..(909): n is a, c, g, or t
  misc_feature (913)..(913): n is a, c, g, or t
  misc_feature (915)..(915): n is a, c, g, or t
  misc_feature (917)..(917): n is a, c, g, or t
  misc_feature (920)..(920): n is a, c, g, or t
  misc_feature (922)..(922): n is a, c, g, or t
  misc_feature (925)..(925): n is a, c, g, or t
  misc_feature (928)..(928): n is a, c, g, or t
  misc_feature (936)..(936): n is a, c, g, or t
  misc_feature (943)..(943): n is a, c, g, or t
  misc_feature (948)..(949): n is a, c, g, or t
  misc_feature (952)..(952): n is a, c, g, or t
ancanntagagaaattactatgagaggatcgcatcaccatcaccatcacggatcctatttaggtgacactatagaatcgtcgacccacgcgtccgcccacgcgtccgaatttctcttggacaaatctgcagaaaaggctcttgggaaggcagcatctcacattaaaagcattaagaatgtgacagagctgaagctttctgataatcctgcctgggaaggggataaaggaaacactaaaggtgacaagcacgatgacctccagcgggcgcgtttcatctgccccgttgtgggcctggagatgaacggccgacacaggttctgcttccttcggtgctgcggctgtgtgttttctgagcgagccttgaaagagataaaagcggaagtttgccacacgtgtggggctgccttccaggaggatgatgtcatcgtgctcaatggcaccaaggaggatgtggacgtgctgaagacaaggatggaggagagaaggctgagagcgaagctggaaaagaaaacaaagaaacccaaggcagcagagtctgtttcaaaaccagatgtcagtgaagaagccccagggccatcaaaagttaagacagggaagcctgaagaagccagccttgattctagagagaagaaaaccaacttggctcccaaaagcacagcaatgaatgagagctcttctggaaaagctgggaagcctccgtgtggagccacaaagaggtccatcgctgacagtgaagaatcggaggcctacaagtccctctttaccactcacagctccgccaagcgctccaaggaggagtctgccccactgggtcacccacacgtcctactgcttctgaagcccgcactgccnccgctcntgccccaaaaaggttgtttaantttccncgtaaggcaggncccntttgngccncngnaangnccngcnggggggtnccccccnaaaanntcnggggcaaaaa

SEQ ID NO: 50 - DNA, 1179 bp, Human
  misc_feature (914)..(914): n is a, c, g, or t
  misc_feature (933)..(933): n is a, c, g, or t
  misc_feature (957)..(957): n is a, c, g, or t
  misc_feature (962)..(962): n is a, c, g, or t
  misc_feature (977)..(977): n is a, c, g, or t
  misc_feature (979)..(980): n is a, c, g, or t
  misc_feature (982)..(982): n is a, c, g, or t
  misc_feature (985)..(985): n is a, c, g, or t
  misc_feature (1008)..(1008): n is a, c, g, or t
  misc_feature (1031)..(1031): n is a, c, g, or t
  misc_feature (1035)..(1035): n is a, c, g, or t
  misc_feature (1039)..(1039): n is a, c, g, or t
  misc_feature (1045)..(1045): n is a, c, g, or t
  misc_feature (1058)..(1058): n is a, c, g, or t
  misc_feature (1077)..(1077): n is a, c, g, or t
  misc_feature (1084)..(1084): n is a, c, g, or t
  misc_feature (1097)..(1098): n is a, c, g, or t
  misc_feature (1104)..(1104): n is a, c, g, or t
  misc_feature (1121)..(1121): n is a, c, g, or t
  misc_feature (1124)..(1124): n is a, c, g, or t
  misc_feature (1127)..(1127): n is a, c, g, or t
  misc_feature (1131)..(1131): n is a, c, g, or t
  misc_feature (1136)..(1137): n is a, c, g, or t
  misc_feature (1144)..(1144): n is a, c, g, or t
  misc_feature (1146)..(1146): n is a, c, g, or t
  misc_feature (1155)..(1156): n is a, c, g, or t
  misc_feature (1169)..(1169): n is a, c, g, or t
  misc_feature (1176)..(1176): n is a, c, g, or t
ttagaggaaaattactatgagaggatcgcatcaccatcaccatcacggatcctatttaggtgacactatagaatcgtcgacccacgcgtccggggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccngagataaaccgaaggagantgacaattacgagagtccctctcnggaanaccgtgagcctggancnncntcngcgggagtatgccaccgtgaagnaaaaaatgaaaggctgcaaaaanaagncgcnaaaagnaaaaacccacccncacctgatccaggagtccnctgcacngccagaactaacnnggggcnggaagaagggaatttangcnccncctnccccnnaaatgananctttgccgnnccccaagggactnaaggctntaa

SEQ ID NO: 51 - DNA, 986 bp, Human
  misc_feature (881)..(881): n is a, c, g, or t
  misc_feature (899)..(899): n is a, c, g, or t
  misc_feature (972)..(972): n is a, c, g, or t
tagagaaattactatgagaggatcgcatcaccatcaccatcacggatcctatttaggtgacactatagaatcgtcgacccacgcgtccggtctcatgaagccgctggtcgtgttcgtcctcggcggccccggcgccggcaaggggacccagtgcgcccgcatcgtcgagaaatatggctacacacacctttctgcaggagagctgcttcgtgatgaaaggaagaacccagattcacagtatggtgaacttattgaaaagtacattaaagaaggaaagattgtaccagttgagataaccatcagtttattaaagagggaaatggatcagacaatggctgccaatgctcagaagaataaattcttgattgatgggtttccaagaaatcaagacaaccttcaaggatggaacaagaccatggatgggaaggcagatgtatctttcgttctcttttttgactgtaataatgagatttgtattgaacgatgtcttgagaggggaaagagtagtggtaggagtgatgacaacagagagagcttggaaaagagaattcagacctaccttcagtcaacaaagccaattattgacttatatgaagaaatggggaaagtcaagaaaatagatgcttctaaatctgttgatgaagtttttgatgaagttgtgcagatttttgacaaggaaggctaattctaaacctgaaagcatccttgaaatcatgcttgaatattgctttgatagctgctatcatgacccctttttaaggcaattctaatctttcataactacatctcaattagtggctggaaagtacatggtaaaacaaagtaaatttttttatgttcttttttttggccacaggagtagacagtgaattcaggtttancttcaccttagttatggngctcaccaaacgaagggtatcagctatttttttttaaattcaaaaaaaaatatcccttttatagttggggccntctgggagcaaaac

SEQ ID NO: 52 - DNA, 1177 bp, Human
  misc_feature (1)..(1): n is a, c, g, or t
  misc_feature (825)..(825): n is a, c, g, or t
  misc_feature (834)..(834): n is a, c, g, or t
  misc_feature (857)..(857): n is a, c, g, or t
  misc_feature (871)..(871): n is a, c, g, or t
  misc_feature (900)..(900): n is a, c, g, or t
  misc_feature (911)..(911): n is a, c, g, or t
  misc_feature (913)..(913): n is a, c, g, or t
  misc_feature (916)..(916): n is a, c, g, or t
  misc_feature (967)..(967): n is a, c, g, or t
  misc_feature (976)..(976): n is a, c, g, or t
  misc_feature (980)..(980): n is a, c, g, or t
  misc_feature (982)..(982): n is a, c, g, or t
  misc_feature (991)..(991): n is a, c, g, or t
  misc_feature (998)..(998): n is a, c, g, or t
  misc_feature (1004)..(1004): n is a, c, g, or t
  misc_feature (1012)..(1012): n is a, c, g, or t
  misc_feature (1035)..(1035): n is a, c, g, or t
  misc_feature (1053)..(1053): n is a, c, g, or t
  misc_feature (1056)..(1056): n is a, c, g, or t
  misc_feature (1059)..(1059): n is a, c, g, or t
  misc_feature (1066)..(1066): n is a, c, g, or t
  misc_feature (1071)..(1071): n is a, c, g, or t
  misc_feature (1076)..(1076): n is a, c, g, or t
  misc_feature (1092)..(1092): n is a, c, g, or t
  misc_feature (1104)..(1104): n is a, c, g, or t
  misc_feature (1111)..(1111): n is a, c, g, or t
  misc_feature (1121)..(1121): n is a, c, g, or t
  misc_feature (1131)..(1131): n is a, c, g, or t
  misc_feature (1134)..(1134): n is a, c, g, or t
  misc_feature (1142)..(1143): n is a, c, g, or t
  misc_feature (1145)..(1146): n is a, c, g, or t
  misc_feature (1158)..(1158): n is a, c, g, or t
  misc_feature (1164)..(1164): n is a, c, g, or t
  misc_feature (1170)..(1170): n is a, c, g, or t
  misc_feature (1172)..(1173): n is a, c, g, or t
  misc_feature (1177)..(1177): n is a, c, g, or t
ntagagaaattactatgagaggatcgcatcaccatcaccatcacggatcctatttaggtgacactatagaatcgtcgacccacgcgtccgcggatgtgatcctctgcatgtccttcaacacggacggcagcctgctcaccaccacgtgcaaggacaagaagctgcgtgtgattgagccccgctctggccgtgttctgcaggaggccaactgcaaaaaccacagagtgaaccgggtggtgttcctggggaacatgaagcggctcctcacgacaggggtctccaggtggaacacaagacagattgccctctgggaccaggaggacctctccatgcccctgatcgaagaggaaattgatgggctctctggcctcctgttccccttctatgatgctgacacccacatgctctacctggctggaaagggtgatggaaacatccggtactacgagatcagcactgagaagccctacctgagttacctcatggagttccgctccccagccccgcagaaaggcctaggggtcatgcccaagcacgggctggatgtgtcagcctgcgaggtgttccgcttctacaagctggtgactctcaagggcctgatcgagcccatctccatgatcgtgccccggaggtcagattcctaccaggaagacatttacccaatgacaccaggcacggagccagcactgaccccggatgaatggctgggaggcatcaaccgagatcccgtgctgatgtctttgaaagaaggctataagaagtcctcaaaaatggtatttaaggctcccatcaaagaaaagaagagtgttgtggtcaacggaatanatttattanaaaatgtcccacccaggacaganaatgagctccttcnatgttcttccggcagcaggatgaaattcnacggttgaaananganctggcccaaaaggacatccgcattcggcagctccactggaatgaaaaactngcgcaacancccnanaactgttanctcccanctgggntgttttcnaaccgatttctccgtcgtttcantcatccctaaattccccntancantgacccnaaaanaaccngaaaggatggggccancttgagaccccncctaccnctcaaaatgnaaccaccttnacntctgactnngnnaaaaaatcccantttggnaacccngnnggan

SEQ ID NO: 53 - DNA, 708 bp, Human
  misc_feature (703)..(704): n is a, c, g, or t
cccccgagagagagattactatgagaggatcgcatcaccatcaccatcacggatcctatttaggtgacactatataatcgtcgactctggaccttggctgtcactcagttgcaaccacccgggccgaccctcgaggcctcctgcactccgcccggacccccggccccgccgtggctatccagtcagttcgctgctattcccatgggtcacaggagacagatgaggagtttgatgctcgctgggtaacatacttcaacaagccagatatagatgcctgggaattgcgtaaagggataaacacacttgttacctatgatatggttccagagcccaaaatcattgatgctgctttgcgggcatgcagacggttaaatgattttgctagtacagttcgtatcctagaggttgttaaggacaaagcaggacctcataaggaaatctacccctatgtcatccaggaacttagaccaactttaaatgaactgggaatctccactccggaggaactgggccttgacaaagtgtaaaccgcatggatgggcttccccaaggatttattgacattgctacttgagtgtgaacagttacctggaaatactgatgataacatattaccttatttgaacaagttttcctttattgagtaccaagccatgtaatggtaacttggactttaataaaagggaaatgagtttgaactgannaaac

SEQ ID NO: 54 - DNA, 1179 bp, Human
  misc_feature (774)..(774): n is a, c, g, or t
  misc_feature (824)..(824): n is a, c, g, or t
  misc_feature (834)..(834): n is a, c, g, or t
  misc_feature (887)..(887): n is a, c, g, or t
  misc_feature (910)..(910): n is a, c, g, or t
  misc_feature (929)..(929): n is a, c, g, or t
  misc_feature (931)..(931): n is a, c, g, or t
  misc_feature (946)..(946): n is a, c, g, or t
  misc_feature (964)..(964): n is a, c, g, or t
  misc_feature (976)..(976): n is a, c, g, or t
  misc_feature (985)..(985): n is a, c, g, or t
  misc_feature (1009)..(1009): n is a, c, g, or t
  misc_feature (1026)..(1026): n is a, c, g, or t
  misc_feature (1035)..(1035): n is a, c, g, or t
  misc_feature (1042)..(1042): n is a, c, g, or t
  misc_feature (1047)..(1047): n is a, c, g, or t
  misc_feature (1056)..(1056): n is a, c, g, or t
  misc_feature (1063)..(1063): n is a, c, g, or t
  misc_feature (1071)..(1071): n is a, c, g, or t
  misc_feature (1078)..(1078): n is a, c, g, or t
  misc_feature (1080)..(1080): n is a, c, g, or t
  misc_feature (1085)..(1085): n is a, c, g, or t
  misc_feature (1092)..(1092): n is a, c, g, or t
  misc_feature (1096)..(1096): n is a, c, g, or t
  misc_feature (1106)..(1106): n is a, c, g, or t
  misc_feature (1108)..(1108): n is a, c, g, or t
  misc_feature (1113)..(1113): n is a, c, g, or t
  misc_feature (1125)..(1125): n is a, c, g, or t
  misc_feature (1143)..(1143): n is a, c, g, or t
  misc_feature (1147)..(1147): n is a, c, g, or t
  misc_feature (1167)..(1167): n is a, c, g, or t
  misc_feature (1169)..(1169): n is a, c, g, or t
  misc_feature (1177)..(1177): n is a, c, g, or t
tagagaaattactatgagaggatcgcatcaccatcaccatcacggatcctatttaggtgacactatagaatcgtcgacccacgcgtccggtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatganggaagcagctgccaccgagatccgccgagccatcacaggtcgcatcccanaaagcttaanaaattgtgtgaacaaggaattctttgtcacatcagcgccttggtcagtaatanaccagcaagcaattcatcctganctcatggtgccacatacananatccgccaggcatcntgggtgtggctccaggangaattcctgcanccatggaanggatcatccctggaggcatcccantgactcaaaacctcccnaaaagtggnaaattcnttccnaaacgcctnttccaanccagcccnaaaaaananggggnaaaatcnaaancccccccacnanccaanaaccaaaaatgnccaaaaggtaatccctcnaaanaccttgggaaccaaaaaacngnggaaaatnat

SEQ ID NO: 55 - DNA, 879 bp, Human
  misc_feature (812)..(812): n is a, c, g, or t
caatagagagatactatgagaggatgcatcaccatcaccatcacggatcctatttaggtgacactatagaatcgtcgactctggaccttggctgtcactcagttagccagggtgttgatgacttcctccaagccaaggccaaatccaagactttggacttcattgatgtactcctgctgagcaaggatgaagacgggaagaagttatctgatgaggacataagagcagaagctgacacctttatgtttgagggccatgacaccacggccagtggtctctcctgggtcctgtaccaccttgcaaagcacccagaataccaggagcgctgccggcaggaggtgcaagaacttctgaaggaccgtgagcctaaagagattgaatgggacgacctggcccatttgcccttcctgaccatgtgcatgaaggagagcctgcggctgcatcccccagtcccggtcatctcccgccatgtcacccaggacattgtgctcccagacggccgggtcatccccaaaggcattatctgcctcatcagtgttttcggaacccatcacaacccagctgtgtggccggaccctgaggtctacgacccctttcgctttgacccagagaacatcaaggagaggtcacctctggcttttattcccttctcggcagggcccaggaactgcatcgggcagacgttcgcgatggcggagatgaaggtggtcctggcgctcacgctgctgcgcttccgcgtcctgcctgaccacaccgagcccgcaggaagccggagctggtcctgcgcgcagagggcggactttggctgcggntggacccctgagctgagtctgcagaaaccactccgacccacaaatgacccctgatcatcaaatgaaa

SEQ ID NO: 56 - DNA, 1081 bp, Human
  misc_feature (636)..(636): n is a, c, g, or t
  misc_feature (822)..(822): n is a, c, g, or t
  misc_feature (875)..(875): n is a, c, g, or t
  misc_feature (906)..(906): n is a, c, g, or t
  misc_feature (908)..(909): n is a, c, g, or t
  misc_feature (916)..(916): n is a, c, g, or t
  misc_feature (922)..(922): n is a, c, g, or t
  misc_feature (957)..(957): n is a, c, g, or t
  misc_feature (970)..(970): n is a, c, g, or t
  misc_feature (974)..(974): n is a, c, g, or t
  misc_feature (987)..(987): n is a, c, g, or t
  misc_feature (992)..(992): n is a, c, g, or t
  misc_feature (998)..(998): n is a, c, g, or t
  misc_feature (1009)..(1009): n is a, c, g, or t
  misc_feature (1011)..(1011): n is a, c, g, or t
  misc_feature (1017)..(1017): n is a, c, g, or t
  misc_feature (1026)..(1026): n is a, c, g, or t
  misc_feature (1031)..(1031): n is a, c, g, or t
  misc_feature (1034)..(1035): n is a, c, g, or t
  misc_feature (1040)..(1040): n is a, c, g, or t
  misc_feature (1045)..(1045): n is a, c, g, or t
  misc_feature (1051)..(1051): n is a, c, g, or t
  misc_feature (1063)..(1063): n is a, c, g, or t
  misc_feature (1074)..(1075): n is a, c, g, or t
  misc_feature (1078)..(1078): n is a, c, g, or t
  misc_feature (1080)..(1080): n is a, c, g, or t
agaaattaactatgagaggatcgcatcaccatcaccatcacggatcctatttaggtgacactatagaatcgtcgacccacgcgtccgcgctggtgtatgatgaggaaatcatggctggctgggcacctgatgactctaacctcaacacaacctgccccttctgcgcctgcccctttgtgcccctgctcagtgtccagacccttgattcccggcccagtgtccccagccccaaatctgctggtgccagtggcagcaaagatgctcctgtccctggtggtcctggccctgtgctcagtgaccgaaggctctgccttgctctggatgagccccagctctgcaacgggcacatgggggtaagggctgggccaaaggggcatgaggaacgggaatgttgccctgtgtggggcctgtggggtgccagggagagatgggcacatctcttgcccttgagggcaaggggcatcccaaaagctgttggatgtggtggctcagtgggaggcaaggctctggggatgtacatgccctctactgccctccccctttgtgcctgatagggagcctcccggcgggttgagagtggggcatgggcatacctgagccccctggtgctgcgtaaggagctggagtcgctggtanagaacgagggcagtgaggtgctggcgttgcctgaactgccctctgcccaccccatcatcttctggaaccttttgtggtatttccaacggctacgcctgcccagtattctaccaggcctggtgctggcctcctgtgatgggccttcgcactcccaggccccatctccttggctaacccctgatccanccctctgttcaggtacggctgctgtgggatgtactgacccctgaccccaatanctgcccacctctctatgtgctctggaaggtncnnaattgantctggnatttggcctgggtggggaagggtggggtcccatancccaaaaaggctnaatnaattctggggggnctttnttttcnttttcatccangncaaaantcccccaancgggnggnnaaggnccagnccctgnaactgcatcccnttaatttggcnntgntng

SEQ ID NO: 57 - DNA, 840 bp, Human
  misc_feature (782)..(782): n is a, c, g, or t
  misc_feature (787)..(787): n is a, c, g, or t
  misc_feature (793)..(793): n is a, c, g, or t
  misc_feature (801)..(801): n is a, c, g, or t
gaattactatgagaggacgcatcccatcaccatcacggatcctatttaggtgacactatagaatcgtcgactctggaccttggctgtcactcagttgggatgacccgccgggacccgctcgcaaataaggtggccctggtaacggcctccaccgacgggatcggcttcgccatcgcccggcgtttggcccaggacggggcccatgtggtcgtcagcagccggaagcagcagaatgtggaccaggcggtggccacgctgcagggggaggggctgagcgtgacgggcaccgtgtgccatgtggggaaggcggaggaccgggagcggctggtggccacggctgtgaagcttcatggaggtatcgatatcctagtctccaatgctgctgtcaaccctttctttggaagcataatggatgtcactgaggaggtgtgggacaagctctggatggacaaggaaaaagaggaaagcatgaaagaaaccctgcggataagaaggttaggcgagccagaggattgtgctggcatcgtgtctttcctgtgctctgaagatgccagctacatcactggggaaacagtggtggtgggtggaggaaccccgtcccgcctctgaggaccgggagacagcccacaggccagagttgggctctagctcctggtgctgttcctgcattcacccactggcctttcccacctctgctcaccttactgttcacctcatcaaatcagttctgccctgtgaaaagatccagccttccctgccgtcaaggtggcgtcttactcggnattcntgctgntgttgggnccttgggtaaaggcctcccctgagaacacagacagcctg

SEQ ID NO: 58 - DNA, 920 bp, Human
tatgagaggatcgcatcaccatcaccatcacggatcctatttaggtgacactatagaatcgtcgacccacgcgtccggggagtgcggggcgcgcggtgacagcgcggggttggcggcgtgggacccagggggcgacagaggcagcagcagcccgaggcctgaggagaggggaccggcggcggcggcaatgctggagacccttcgcgagcggctgctgagcgtgcagcaggatttcacctccgggctgaagactttaagtgacaagtcaagagaagcaaaagtgaaaagcaaacccaggactgttccatttttgccaaagtactctgctggattagaattacttagcaggtatgaggatacatgggctgcacttcacagaagagccaaagactgtgcaagtgctggagagctggtggatagcgaggtggtcatgctttctgcgcactgggagaagaaaaagacaagcctcgtggagctgcaagagcagctccagcagctcccagctttaatcgcagacttagaatccatgacagcaaatctgactcatttagaggcgagttttgaggaggtagagaacaacctgctgcatctggaagacttatgtgggcagtgtgaattagaaagatgcaaacatatgcagtcccagcaactggagaattacaagaaaaataagaggaaggaacttgaaaccttcaaagctgaactagatgcagagcacgcccagaaggtcctggaaatggagcacacccagcaaatgaagctgaaggagcggcagaagttttttgaggaagccttccagcaggacatggagcagtacctgtccactggctacctgcagattgcagagcggcgagagcccataggcagcatgtcatccatggaagtgaacgtggacatgctggagcagatggacctgatgg

SEQ ID NO: 59 - DNA, 548 bp, Human
tgagaggtcgcatcaccatcaccatcacggatcctatttaggtgacactatagaatcgtcgacccacgcgtccgcccacgcgtccgctcgcctggccaccgggccacggccccacagacccagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggc

SEQ ID NO: 60 - DNA, 727 bp, Human
  misc_feature (3)..(3): n is a, c, g, or t
  misc_feature (20)..(20): n is a, c, g, or t
  misc_feature (275)..(275): n is a, c, g, or t
  misc_feature (331)..(331): n is a, c, g, or t
  misc_feature (351)..(351): n is a, c, g, or t
  misc_feature (372)..(372): n is a, c, g, or t
  misc_feature (380)..(380): n is a, c, g, or t
  misc_feature (403)..(403): n is a, c, g, or t
  misc_feature (405)..(405): n is a, c, g, or t
  misc_feature (409)..(409): n is a, c, g, or t
  misc_feature (465)..(465): n is a, c, g, or t
  misc_feature (470)..(470): n is a, c, g, or t
  misc_feature (480)..(480): n is a, c, g, or t
  misc_feature (485)..(487): n is a, c, g, or t
  misc_feature (490)..(490): n is a, c, g, or t
  misc_feature (516)..(516): n is a, c, g, or t
  misc_feature (529)..(529): n is a, c, g, or t
  misc_feature (545)..(545): n is a, c, g, or t
  misc_feature (551)..(551): n is a, c, g, or t
  misc_feature (560)..(560): n is a, c, g, or t
  misc_feature (581)..(581): n is a, c, g, or t
  misc_feature (585)..(585): n is a, c, g, or t
  misc_feature (587)..(587): n is a, c, g, or t
  misc_feature (593)..(593): n is a, c, g, or t
  misc_feature (600)..(600): n is a, c, g, or t
  misc_feature (605)..(605): n is a, c, g, or t
  misc_feature (609)..(609): n is a, c, g, or t
  misc_feature (611)..(611): n is a, c, g, or t
  misc_feature (621)..(621): n is a, c, g, or t
  misc_feature (624)..(624): n is a, c, g, or t
  misc_feature (630)..(630): n is a, c, g, or t
  misc_feature (634)..(634): n is a, c, g, or t
  misc_feature (641)..(641): n is a, c, g, or t
  misc_feature (644)..(644): n is a, c, g, or t
  misc_feature (647)..(648): n is a, c, g, or t
  misc_feature (650)..(650): n is a, c, g, or t
  misc_feature (681)..(681): n is a, c, g, or t
  misc_feature (684)..(684): n is a, c, g, or t
  misc_feature (693)..(693): n is a, c, g, or t
  misc_feature (697)..(698): n is a, c, g, or t
ttnattaaagaggagaaatnacttgagaggatcgcatcaccatcaccatcacggatcctatttaggtgacactatagaatcgtcgacccacgcgtccgggctgctcttcatggctaatgaagcagacttggatgaagagctggtcattaagggatccatcctacagaagcatcctagaatacgtttccacacgggtcttgtggatgcccacctctactgtttgaaaaaatacatcgtggatttcctaatggaaaatgggtcaataaccttctatnccggaggggaacctggtttccatatttaagggagaaaacaggttttccttagcttnctcacaacagggccaagaanaaaaagaggggggtttaaaanaaaaaggngccggaggccccttaaaattttnanaggntttttaaaaaaaagcccaaacccctggaacccggggtccccttttaaaaacccccnctggnaaaacccccntcccnnnggnaaacaagggggggaaaaaattttttncccaaaaaaaaanagggggggccgggttntttgtnccccccatntaaaaaaaaaaaggggggctntttntntttttnggggggngaacncccncnggggggcctnttntttggngggnaaaaaanaanaannangggggggcccccaaaaaaggggggggggggnctnttttttttncccnnaaaaaaaaacccccccccccttttttttt

SEQ ID NO: 61 - DNA, 792 bp, Human
  misc_feature (692)..(700): n is a, c, g, or t
  misc_feature (702)..(715): n is a, c, g, or t
cgatagagagatactatgagaggatcgcatcccatcaccatcacggatcctatttaggtgacactatagaatcgtcgactctggaccttggctgtcactcagttaacatcctaggcgaggcgcgaccggaggacgccggcgccccgttcgagcaggccggtcagaagtactggggccccgccagcccgacccacaagctacccccaagcttcccggggaacaaagacgagctcatgcagcacatggacgaggtcaacgacgagctcatccggaaaatcagcaacatcagggcgcagccacagaggcacttccgcgtggagcgcagccagcccgtgagccagccgctcacctacgagtcgggtccggacgaggtccgcgcctggctggaagccaaggccttcagcccgcggatcgtggagaacctgggcatcctgaccgggccgcagctcttctccctcaacaaggaggagctgaagaaagtgtgcggcgaggagggcgtccgcgtgtacagccagctcaccatgcagaaggccttcctggagaagcagcaaagtgggtcggagctggaagaactcatgaacaagtttcattccatgaatcagaggaggggagaggacagctaggcccagctgccttgggctggggcctgcggaggggaagcccacccacaatgcatggagtattatttttannnnnnnnnannnnnnnnnnnnnnaaaaacgagcggccgctccctataatgagtcgtattaggcttattagctgagcttggactcctgttgatagatccag

SEQ ID NO: 62 - DNA, 885 bp, Human
tgagaggtcgcatcaccatcaccatcacggatcctatttaggtgacactatagaatcgtcgacccacgcgtccgcctccctctccgagcttgagaatttttcttccgaaataatcagcttcaagtccatggaggacctcgtaaatgaatttgatgagaagctcaatgtctgctttcggaactacaacgccaagaccgagaacctagctcccgtgaagaaccagttacagatccaagaggaggaggagacccttcaggacgaggaggtttgggatgctctgacagacaattacatcccttcactctcagaagactggagggatccaaacatcgaggctctgaatggcaactgctctgacactgagatccatgagaaagaagaggaagagttcaatgagaagagtgaaaatgattccggtatcaacgaggagcctctgctcacagcagatcaggtaattgaggagattgaggaaatgatgcagaactccccagaccctgaggaagaagaggaggttctggaagaagaggatggaggagaaacttcctcccaggcagactcggtcctcctgcaggagatgcaggcattgacacagaccttcaacaacaactggtcctatgaagggctgaggcacatgtctgggtctgagctgaccgagctgctggaccaggtggagggtgccatccgtgacttctcggaggagctggtgcagcagctggcccgccgggacgagctggagtttgagaaggaagtgaagaactcctttatcacggtgcttattgaggttcagaacaagcagaaggagcagcgagaactgatgaaaaagaggcggaaagagaaagggctgagcctgcagagcagccggatagagaagggaaaccagatgcc

SEQ ID NO: 63 - DNA, 1229 bp, Human
ggaacgcttatactgaattacctataaaaaggcgtatccgaggccctttcgtcttcacctcgagaaatcataaaaaatttatttgctttgtgagcggataacaattataatagattcaattgtgagcggataacaatttcacacagaattcattaaagaggagaaattaactatgagaggatcgcatcaccctcaccatcacggtcgacccacgcgtccggctgcctcgggccgggccgagaccccgcagaagcctccctacagctacatcgcgctcatcgccatggcgatccaggacgcgcccgagcagagggtcacgctcaacggcatctaccagttcatcatggaccgcttccccttctaccacgacaaccggcagggctggcagaacagcatccgccacaacctctcgctcaacgactgcttcgtcaaggtgccccgcgagaaagggcggccgggcgggggcaactactggacgctggactcccgctgcctgaacatgtttgagaacggcgactaccggcgacggaagaggcagcccctcccgggccccccagtgccacaaccgcgcagctacacaggcccccaccaaccacgacgtgaaccgcgaacgagcaatcccagcagccgatcgaccacagtctgccctaccggcctccccgtgcacccgaccccaaagtccacagaacaacaccattaaccgcccaaaatcacgcaagcaaagagcaccgcccaacccccacccagagcgacaacagactggagcaatcccacagccccctccgaacccgcgccagatgcccgcaaagcgaccagaccagaaccatcacaaacgtacaccaccctcaaccacgctgcgacacgacccgcaagcccggcccgcagcgcggccctacccacagcctacaatcggacgaccacagcctgcgccgagcctatcagacaggccccccccacccaagcacagcaaccaaccacccaagaccactacacagcatgaccacagagcacgattaccaaagagcccacatcgagacgacagcataaccggcaacactatccacaaagtcccggcaccgtgacccgacacataaactggggccgcccctactccgacgagaccaccagttccacccctacgcagcccccccaagaacaacaggctcaacgagcaccaagcttgagcaccacgtccccccgccaggcgatcataacacaacgatcacgcg

SEQ ID NO: 64 - DNA, 844 bp, Human
  misc_feature (533)..(533): n is a, c, g, or t
  misc_feature (691)..(691): n is a, c, g, or t
actatgagaggtcgcatcccatcaccatcacggatcctatttaggtgaactatagaatcgtcgactctggaccttggctgtcactcagtttatgagttagtgaacaactatcagcctgaggttctgtggtctgatggtgacggaggagcaccggatcaatactggaacagcacaggcttcttggcctggttatataatgaaagcccagttcggggcacagtagtcaccaatgatcgttggggagctggtagcatctgtaagcatggtggcttctatacctgcagtgatcgttataacccaggacatcttttgccacataaatgggaaaactgcatgacaatagacaaactgtcctggggctataggagggaagctggaatctctgactatcttacaattgaagaattggtgaagcaacttgtagagacagtttcatgtggaggaaatcttttgatgaatattgggcccacactagatggcaccatttctgtagtttttgaggagcgactgaggcaaatggggtcctggctaanagtcaatggagaagctatttatgaaacccatacctggcgatcccagaatgacactgtcaccccagatgtgtggtacacatccaagcctaaagaaaaattagtctatgccatttttcttaaatggcccacatcaggacagctgttccttggccatcccnaagctattctgggggcaacagaggtgaaactactgggccatggacagccacttaactggatttctttggagcaaaatggcattatggtagaactgccaccagctaccattcatcaaatgccgtgtaatggggctgggctctagccctacctaa

SEQ ID NO: 65 - DNA, 1007 bp, Human
  misc_feature (820)..(820): n is a, c, g, or t
  misc_feature (825)..(825): n is a, c, g, or t
  misc_feature (873)..(873): n is a, c, g, or t
  misc_feature (896)..(896): n is a, c, g, or t
  misc_feature (921)..(921): n is a, c, g, or t
  misc_feature (943)..(943): n is a, c, g, or t
  misc_feature (945)..(945): n is a, c, g, or t
  misc_feature (950)..(950): n is a, c, g, or t
  misc_feature (955)..(955): n is a, c, g, or t
  misc_feature (960)..(961): n is a, c, g, or t
  misc_feature (968)..(968): n is a, c, g, or t
  misc_feature (985)..(985): n is a, c, g, or t
  misc_feature (993)..(993): n is a, c, g, or t
  misc_feature (996)..(996): n is a, c, g, or t
  misc_feature (998)..(998): n is a, c, g, or t
  misc_feature (1001)..(1001): n is a, c, g, or t
  misc_feature (1003)..(1003): n is a, c, g, or t
agaaattactatgagaggatcgcatcaccatcaccatcacggatcctatttaggtgacactatagaatcgtcgacccacgcgtccggccctgcctctttcgatttggggtcttcatccttcatccagtggggtctggcctggctggactctgtctttgacctggtcatggtggctgagtacttcgatgagtcattggttctgctggcagatgccctgtgctggggtctagatgacgtggtgggcttcatgcacaatgcccaggctggacataagcagggcctcagcactgtcagcaacagtggactgactgcggaggaccggcagctgactgcacgggcccgagcctggaacaacctggactgggctctctatgtccacttcaaccgcagtctctgggcacggatagagaaatacggccagggccggctgcagacagctgtggccgagctccgggctcgccgagaggccctagcgaaacattgtctggtagggggtgaggcttctgaccccaaatacatcactgatcgccggttccgccccttccagtttgggtcagctaaggttttgggctatatacttcggagtggattgagcccccaagaccaagaggaatgtgagcgcctagctacccctgagctccagtacaaggacaagctggatgtcaagcagttcccccctaccgtctcactgcccctcaagacttcaaggccactctccccataaacatcagactacagatttaggtggaagagcagccatgtttgaagggcacatgtgatgagtgggggggcagcaagatgccatttctgcatctcccanaaggnatgagtcttttgtccccgatgcaagccccctcttcgctgggctcccangaaagggtttccctcctccaccntccactcattttgttctttcccccnaactttttttttttttgaaaangnaattnttgcntctgnncccccangctggaagggcaagggnaatgattntcngnttnantgaa

SEQ ID NO: 66 - DNA, 869 bp, Human
  misc_feature (736)..(736): n is a, c, g, or t
  misc_feature (768)..(768): n is a, c, g, or t
  misc_feature (817)..(817): n is a, c, g, or t
  misc_feature (827)..(827): n is a, c, g, or t
  misc_feature (857)..(857): n is a, c, g, or t
  misc_feature (864)..(864): n is a, c, g, or t
  misc_feature (869)..(869): n is a, c, g, or t
ccccaaaggatagagagaatacatgagaggatgcatcaccatcaccatcacggatcctatttaggtgacactatagaatcgtcgactctggaccttggctgtcactcagttaaatcagagatggcagcggtaaaggcatcaacatcgaaagctaccaggccttggtattctcatccggtatatgcaagatactggcaacattatcatcaagcaatggcttggatgcaaagccatcacaatgcctacaggaaggccgtggaatcctgtttcaatcttccatggtacttaccttctgcgcttcttccccaaagctcttacgataatgaggctgcgtatcctcagtccttctatgaccatcatgtggcctggcaggactacccctgcagttcttcacatttcagaagatctgggcagcatccacgttacagcagtaggatccaggcatccacaaaagaagaccaagctttgtccaaagaggaagagatggagactgagtcagatgcagaggtagaatgtgacctgagcaatatggaaatcactgaagagctccgccagtactttgcagagaccgagaggcatagagaagaacgacggcggcagcagcagctggatgcagagcgcctggacagctatgtgaacgctgaccacgacctgtactgcaacacccgccggtcggtagaagccccaactgagaggcctggtgagcggcgccaggccgagatgaaagcgttgtacngggacagtgctgccaagatccaagccatggangccgcggtgcagctgagctttgacaagcactgtgaccgaaagcagcccnagtactggcnggtcatccccctgaagttctgagctcaggncacaggntaccn

SEQ ID NO: 67 - DNA, 883 bp, Human
catcaccatcaccatcacggatcctatttaggtgacactatagaatcgtcgacccacgcgtccgtgcgtgcggcgggaatcatggctgctcgcagagctctgcacttcgtattcaaagtgggaaaccgcttccagacggcgcgtttctatcgggacgtcctggggatgaaggttctgcggcatgaggaatttgaagaaggctgcaaagctgcctgtaatgggccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagagttgccagacttagaagacttgatgaaaagggagaaccagaagattctgactcccctggtgagcctggacaccccagggaaaagcaacagtacaggtggtcattctggccgaccctgacggacatgaaatttgctttgtcggggatgaagcatttcgagaactttctaagatg

SEQ ID NO: 68 - DNA, 1028 bp, Human
  misc_feature (613)..(613): n is a, c, g, or t
  misc_feature (746)..(746): n is a, c, g, or t
  misc_feature (827)..(827): n is a, c, g, or t
  misc_feature (835)..(835): n is a, c, g, or t
  misc_feature (857)..(857): n is a, c, g, or t
  misc_feature (865)..(865): n is a, c, g, or t
  misc_feature (871)..(871): n is a, c, g, or t
  misc_feature (879)..(879): n is a, c, g, or t
  misc_feature (901)..(901): n is a, c, g, or t
  misc_feature (908)..(908): n is a, c, g, or t
  misc_feature (917)..(917): n is a, c, g, or t
  misc_feature (936)..(936): n is a, c, g, or t
  misc_feature (939)..(939): n is a, c, g, or t
  misc_feature (944)..(944): n is a, c, g, or t
  misc_feature (948)..(948): n is a, c, g, or t
  misc_feature (959)..(959): n is a, c, g, or t
  misc_feature (964)..(964): n is a, c, g, or t
  misc_feature (966)..(966): n is a, c, g, or t
  misc_feature (969)..(969): n is a, c, g, or t
  misc_feature (975)..(975): n is a, c, g, or t
  misc_feature (984)..(984): n is a, c, g, or t
  misc_feature (987)..(987): n is a, c, g, or t
  misc_feature (991)..(991): n is a, c, g, or t
  misc_feature (993)..(994): n is a, c, g, or t
  misc_feature (998)..(1000): n is a, c, g, or t
  misc_feature (1008)..(1008): n is a, c, g, or t
  misc_feature (1020)..(1020): n is a, c, g, or t
  misc_feature (1026)..(1026): n is a, c, g, or t
tagagaaattactatgagaggatcgcatcaccatcaccatcacggatcctatttaggtgacactatagaatcgtcgacccacgcgtccggctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcggnaaggctgcctaccgcacatccccacggttgaaggacaagaagatggatgcccatcctcctcgcctctttgcctgctccaacaagattggacgttttgtgatcgaagaggttcctggtgagctcatgcaggaanacctggcaacggatgacgtcatgcttctggacacctgggaccaggtctttgtttgggttggaaaggattctcaagaagaanaaaagacngaagccttgacttctgctaagnggtacatngaaaanggacccanccaatcgggaatcgggggaacncccatcncccgggggngaaaaaaagggtttttganccntcccntccnttttggggggnttggntnccnttgggntgggaaaanaanaatnanngggnnntggggganccccctttgganaagggncc

SEQ ID NO: 69 - DNA, 1362 bp, Human
  misc_feature (9)..(12): n is a, c, g, or t
  misc_feature (1005)..(1005): n is a, c, g, or t
  misc_feature (1007)..(1007): n is a, c, g, or t
  misc_feature (1113)..(1113): n is a, c, g, or t
gggatcacnnnnttacgacatactatagaggacgcatcaccatcaccatcacggtcgacccacgcgtccgggcgaaggggaggcgccgcggactgtcctttcgtggctcactccctttcctctgctgccgctcggtcacgcttgctctttcaccatgcctggatcacttcctttgaatgcagaagcttgctggccaaaagatgtgggaattgttgcccttgagatctattttccttctcaatatgttgatcaagcagagttggaaaaatatgatggtgtagatgctggaaagtataccattggcttgggccaggccaagatgggcttctgcacagatagagaagatattaactctctttgcatgactgtggttcagaatcttatggagagaaataacctttcctatgattgcattgggcggctggaagttggaacagagacaatcatcgacaaatcaaagtctgtgaagactaatttgatgcagctgtttgaagagtctgggaatacagatatagaaggaatcgacacaactaatgcatgctatggaggcacagctgctgtcttcaatgctgttaactggattgagtccagctcttgggatggacggtatgccctggtagttgcaggagatattgctgtatatgccacaggaaatgctagacctacaggtggagttggagcagtagctctgctaattgggccaaatgctcctttaatttttgaacgagggcttcgtgggacacatatgcaacatgcctatgatttttacaagcctgatatgctatctgaatatcctatagtagatggaaaactctccatacagtgctacctcagtgcattagaccgctgctattctgtctactgcaaaaagatccatgcccagtggcagaaagagggaaatgataaagattttaccttgaatgattttggcttcatgatctttcactcaccatattgtaaactggttcagaaatctctagctcggatgttgctgaatgacttccntnatgaccagaaatagagataaaatagtatctatagtggcctggaaagctttgggggatgtaaattagagacacctactttgataaaaagtggagaagcattatgaanggctactctgacttctcagtcaaaaaacaaagcatctttactggatcaatccaattggaatatgtaccctcctcagaaaagggttcccttcattgtttcaaaccatactccccccccattaccggaaaaaaatggaggtttccttaaggccggttgggcgccccccgcaccctcaaaaccccaaaaactaccccggctctctcttaaaaaaacaccctttttgttctaaaagggtttttcaaaaagggg

SEQ ID NO: 70 - DNA, 1368 bp, Human
  misc_feature (1)..(2): n is a, c, g, or t
nnaaaagagatttgtagatatactgacttacctataaataggcgtatcacgaggccctttcgtcttcacctcgagaaatcataaaaaatttatttgctttgtgagcggataacaattataatagattcaattgtgagcggataacaatttcacacagaattcattaaagaggagaaattaactatgagaggatcgcatcaccatcaccatcacggtcgacccacgcgtccgcggacgcgtgggcggtttttggaatgcttgaaggctgctgagaaagtaactgtgatcaccaaacataacgatgatgagcagtacgcttgggagtcctcagcagggggatcattcacagtgaggacagacacaggtgaacctatgggtcgtggaacaaaagttatcctacacctgaaagaagaccaaactgagtacttggaggaacgaagaataaaggagattgtgaagaaacattctcagtttattggatatcccattactctttttgtggagaaggaacgtgataaagaagtaagcgatgatgaggctgaagaaaaggaagacaaagaagaagaaaaagaaaaagaagagaaagagtcggaagacaaacctgaaattgaagatgttggttctgatgaggaagaagaaaagaaggatggtgacaagaagaagaagaagaagattaaggaaaagtacatcgatcaagaagagctcaacaaaacaaagcccatctggaccagaaatccccggccgcgatccgcatgcgagctcgattagctgagcttggactcctgttgatagatccagtaatgacctcagaactccatctggatttgttcagaacgctcggttgccgccgggcgtttttttattggtgagaatccaagctagcttggcgagattttcaggagctaaggaagctaaaatggagaaaaaatcactggatataccaccgttgatatatcccaatggcatcgtaagaaacttttgaaggatttccatccgttgctccatgtacctataaccaaacgttccactggaaataacggccttttaaagaacctacaaaaaaataagcccaaggtttaacccggcttttatccctttcttgccccctgaagaaggccatccggaatttcctaggaaaaaaaaaagggaacccggggaaagggaaaagggtcccccctgtacaccgctttcccagacaaacagaaccgttttccctctgggaagaaaccacccaatacccggatttcaacaattaattccacagaagcgggttagcggaaaccccgcccttccccacgggtttattaaaaattttttccctccccccctcggggattctcccatttttacaccgcgaaacaacaacct

SEQ ID NO: 71 - DNA, 951 bp, Human
tgagaggtcgcatcaccatcaccatcacggtcgacccacgcgtccggcgccctgtggtgacagctcaggagggtgtgtgcgctcagcaggggccagcatggaccagtctgtggcaatccaggagacgctggctgagggggaatactgcgtcatcgcggtgcaaggtgtgctgtgtgagggggacagccggcagagccgcctcctgggactcgtgcgctaccgcctggagcatggcggccaggaacacgctctcttcctctatacgcaccggaggatggccattaccggggacgatgtctctctggaccagatagtgccagtctcgcgggattttacgctggaagaagtgtccccagatggtgaactctacatccttgatgtgaccgtccagctggacacagcagagcttagcctcgtattccaactgccctttggttcacaaaccaggatgttcctccacgaagttgccagggcctgtccaggcttcgattctgcgacccgggatcctgaattcctgtggctgtctcggtataggtgcgcagagctggagctggagatgccaacgccgcgcggttgtaactcggccctagttacctggccagggtacgcgacaattggcggaggtggttctaactttgatggtttgagaccaaatgggaagggagtgcctatggaccaaagctccaggggtcaagataaaccagaaagcttgcaaccaagacagaataaatccaagtccgaaattactgacatggttcgctcctccactatcacagtgtcggacaaggctcatattttatccatgcagaagtttggactgcgagatacaattgtgaaatcacatctactacagaaagaagaggattacacctatatccagaacttcaggttttttgcgggaacatacaatgtaaatgggcagtcccccaaagaatgcctccggctgtggct

SEQ ID NO: 72 - DNA, 1324 bp, Human
  misc_feature (6)..(6): n is a, c, g, or t
  misc_feature (9)..(10): n is a, c, g, or t
  misc_feature (479)..(479): n is a, c, g, or t
  misc_feature (514)..(514): n is a, c, g, or t
gccccnctnncctaagaatactagagaggatgcatcccatcaccatcacggtcgacccacgcgtccgccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggttccaagccctgcttccctgtggcctccaccgccatctccagccccttcttctaccaagccaggcccagagagctcagtgtccctcctgcagggagcccgcccctctccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctgnagtggactgcagtgaagcagagcttcctgaccgangtggagcagctgtccaggtttcgtcaccccaacattgtggactttgctggctactgtgctcagaacggcttctactgcctgggtacggttttctgcccaacgttccctggaggaccgtttcccctgccaaacccaggcctgcccacctttcctcctggcttagggaatggaattcctctggggaaggcccgggaattccgttttcaactcaagaaagccccaccccctcctggggaaaattaaaaattccaccccccttctggaggaaaggtggaacccaaactgggaaaatttggccgggccccggttacccgctttttccgggccaccccccaccaaaaaaaaatgggggggccccaaaaaaaaaagggggggggcccccggccccacctgccccggggggactttcccgccggggggggggggtgggggaaaccacaccccccccccttttggggggggggggtaaaaaaaaccttgtggggaaaaaagggggtgaaaaaaaccgggggtgcccccaccattttttctaaaaactccctgggaaaaaaagagtgccccgaaggcttttttttttttttaaaaaaccacaccaacccctcctccaaaaagctcgtgctggaaaacaggtggcgtcccccccccccccgcgggaaatcacaacaaaaaaaagttacatctctggcgcggcaccctcccctcactaaataaatgaggcgcgctggtaatcaaacaacatctcactcactccactctaacagacccgctatcgaaatgcactaacctcataccccgtctacagcactgcga

SEQ ID NO: 73 - DNA, 796 bp, Human
  misc_feature (735)..(735): n is a, c, g, or t
  misc_feature (768)..(768): n is a, c, g, or t
ccatagagagattacttgagaggatgcatcccatcaccatcacggatcctatttaggtgacactatagaatcgtcgactctggaccttggctgtcactcagttgaagccggcaagatggcggcggctggggctggccgtctgaggcgggtggcatcggctctgctgctgcggagcccccgcctgcccgcccgggagctgtcggccccggcccgactctatcacaagaaggttgtcgatcattatgaaaatcctagaaacgtggggtcccttgacaagacatctaaaaatgttggaactggactggtgggggctccagcatgtggtgacgtaatgaaattacagattcaagtggatgaaaaggggaagattgtggatgctaggtttaaaacatttggctgtggttccgcaattgcctccagctcattagccactgaatgggtgaaaggaaagacggtggaggaagccttgactatcaaaaacacagatatcgccaaggagctctgccttcctcccgtgaaactgcactgctccatgctggctgaagatgcaatcaaggccgccctggctgattacaaattgaaacaagaacccaaaaaaggagaggcagagaagaaatgagccctccctcggcgaagcctccagcaggccacaccagctgtttcccacctgctgtgcagtcaccttagatgtttcagagccgcttcctctcccactgagagctatgagatacgcancatacttgctgttcacgttatgactctcatggncagcaaatacacagtttcattgtttctg

SEQ ID NO: 74 - DNA, 1189 bp, Human
  misc_feature (1)..(1): n is a, c, g, or t
  misc_feature (876)..(876): n is a, c, g, or t
  misc_feature (892)..(892): n is a, c, g, or t
  misc_feature (925)..(925): n is a, c, g, or t
  misc_feature (946)..(946): n is a, c, g, or t
  misc_feature (954)..(954): n is a, c, g, or t
  misc_feature (956)..(956): n is a, c, g, or t
  misc_feature (977)..(977): n is a, c, g, or t
  misc_feature (988)..(989): n is a, c, g, or t
  misc_feature (993)..(993): n is a, c, g, or t
  misc_feature (996)..(996): n is a, c, g, or t
  misc_feature (999)..(999): n is a, c, g, or t
  misc_feature (1006)..(1006): n is a, c, g, or t
  misc_feature (1008)..(1008): n is a, c, g, or t
  misc_feature (1014)..(1014): n is a, c, g, or t
  misc_feature (1019)..(1019): n is a, c, g, or t
  misc_feature (1030)..(1030): n is a, c, g, or t
  misc_feature (1071)..(1071): n is a, c, g, or t
  misc_feature (1073)..(1073): n is a, c, g, or t
  misc_feature (1082)..(1082): n is a, c, g, or t
  misc_feature (1100)..(1100): n is a, c, g, or t
  misc_feature (1104)..(1104): n is a, c, g, or t
  misc_feature (1109)..(1109): n is a, c, g, or t
  misc_feature (1112)..(1112): n is a, c, g, or t
  misc_feature (1118)..(1118): n is a, c, g, or t
  misc_feature (1125)..(1125): n is a, c, g, or t
  misc_feature (1130)..(1130): n is a, c, g, or t
  misc_feature (1137)..(1137): n is a, c, g, or t
  misc_feature (1142)..(1142): n is a, c, g, or t
  misc_feature (1148)..(1148): n is a, c, g, or t
  misc_feature (1151)..(1153): n is a, c, g, or t
  misc_feature (1161)..(1161): n is a, c, g, or t
  misc_feature (1170)..(1170): n is a, c, g, or t
  misc_feature (1174)..(1174): n is a, c, g, or t
  misc_feature (1176)..(1176): n is a, c, g, or t
naatagagagattactatgagaggatcgcatcaccatcaccatcacggatcctatttaggtgacactatagaatcgtcgacccacgcgtccggtgatatattcatctgtacccaaaaagcagccaggaatatgtcataccagggctttaccaaagacaatggcgtggtgcctgttgttaaggaattaatgggggaggaaattcttggtgcatcactttctgcacctttaacatcatacaaggtgatctatgttctcccaatgctaactattaaggaggataaaggcactggtgtggttacaagtgttccttccgactcccctgatgatattgctgccctcagagacttgaagaaaaagcaagccttacgagcaaaatatggaattagagatgacatggtcttgccatttgagccggtgccagtcattgaaatcccaggttttggaaatctttctgctgtaaccatttgtgatgagttgaaaattcagagccagaatgaccgggaaaaacttgcagaagcaaaggagaagatatatctaaaaggattttatgagggtatcatgttggtggatggatttaaaggacagaaggttcaagatgtaaagaagactattcagaaaaagatgattgacgctggagatgcacttatttacatggaaccagagaaacaagtgatgtccaggtcgtcagatgaatgtgttgtggctctgtgtgaccagtggtacttggattatggagaagagaattggaagaaacagacatctcagtgcttgaagaacctggaaacattctgtgaggagaccaggaggaattttgaagcccccttaggttggctacaagaacatgcttgctcaagaacttatggtctaggcactcncctgccttgggatgancagtggctgaattgaatcactttctgactcccnctatttacatggcattttacncagttgcncncctattgcaggggggtaactngcatggacagnnaaantcnccnctgggcntnaaaccnccacnagatgacccanggaagtttgggaatatgttttcttcaaggaggctccatttncnaaaaactcnaattgcaaggaaaaattnaatncgttnaancggganttgaatnccggnaaccggntgacnttcccnccnnnggaaagantcttgtccnaacncntttcaaataacct

SEQ ID NO: 75 - DNA, 884 bp, Human
  misc_feature (1)..(4): n is a, c, g, or t
  misc_feature (699)..(699): n is a, c, g, or t
  misc_feature (728)..(728): n is a, c, g, or t
  misc_feature (850)..(850): n is a, c, g, or t
  misc_feature (883)..(884): n is a, c, g, or t
nnnnaagatagagagaatactatgagaggacgcatcaccatcaccatcacggatcctatttaggtgacactatagaatcgtcgactctggaccttggctgtcactcagttaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcccgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactngatggaataacaatgaggcatgggctaangatttgaagctggcagactttgcgctgctgtgcctcgatggcaaacggaagcctgtgactgaagctagaagctgcccatctgccatggccccgaatcatgccgtggtgtctcggatggatanggtgaacgcccctgaacagtgttgctccaccann

SEQ ID NO: 76 - DNA, 1245 bp, Human
  misc_feature (907)..(907): n is a, c, g, or t
  misc_feature (920)..(920): n is a, c, g, or t
  misc_feature (925)..(925): n is a, c, g, or t
  misc_feature (950)..(950): n is a, c, g, or t
  misc_feature (962)..(962): n is a, c, g, or t
  misc_feature (980)..(980): n is a, c, g, or t
  misc_feature (983)..(984): n is a, c, g, or t
  misc_feature (1006)..(1006): n is a, c, g, or t
  misc_feature (1009)..(1009): n is a, c, g, or t
  misc_feature (1013)..(1013): n is a, c, g, or t
  misc_feature (1020)..(1020): n is a, c, g, or t
  misc_feature (1028)..(1028): n is a, c, g, or t
  misc_feature (1040)..(1040): n is a, c, g, or t
  misc_feature (1047)..(1047): n is a, c, g, or t
  misc_feature (1050)..(1050): n is a, c, g, or t
  misc_feature (1059)..(1059): n is a, c, g, or t
  misc_feature (1066)..(1066): n is a, c, g, or t
  misc_feature (1080)..(1080): n is a, c, g, or t
  misc_feature (1082)..(1082): n is a, c, g, or t
  misc_feature (1085)..(1085): n is a, c, g, or t
  misc_feature (1100)..(1100): n is a, c, g, or t
  misc_feature (1117)..(1117): n is a, c, g, or t
  misc_feature (1129)..(1129): n is a, c, g, or t
  misc_feature (1136)..(1136): n is a, c, g, or t
  misc_feature (1157)..(1157): n is a, c, g, or t
  misc_feature (1159)..(1159): n is a, c, g, or t
  misc_feature (1167)..(1167): n is a, c, g, or t
  misc_feature (1177)..(1177): n is a, c, g, or t
  misc_feature (1189)..(1189): n is a, c, g, or t
  misc_feature (1194)..(1194): n is a, c, g, or t
  misc_feature (1198)..(1199): n is a, c, g, or t
  misc_feature (1202)..(1202): n is a, c, g, or t
  misc_feature (1210)..(1210): n is a, c, g, or t
  misc_feature (1219)..(1219): n is a, c, g, or t
  misc_feature (1226)..(1226): n is a, c, g, or t
  misc_feature (1231)..(1231): n is a, c, g, or t
  misc_feature (1236)..(1237): n is a, c, g, or t
  misc_feature (1239)..(1239): n is a, c, g, or t
  misc_feature (1241)..(1241): n is a, c, g, or t
  misc_feature (1245)..(1245): n is a, c, g, or t
atagagaaattactatgagaggatcgcatcaccatcaccatcacggatcctatttaggtgacactatagaatcgtcgacccacgcgtccgttcctaaggatgaggcatccgtgtacaagatttgcagagaaatgtatgacgatggagtgggtttaccctttcaaagtcagcctgatcttattggagacaagttagtaggagggctgctttccctcagcctggattactgctttgtcctagaagatgaagatggcatatgtggttatgccttgggcactgtagatgtgaccccctttattaaaaaatgtaaaatttcctggatccccttcatgcaggagaagtataccaagccaaatggtgacaaggaactctctgaggctgagaaaataatgttgagtttccatgaagaacaggaagtactgccagaaactttccttgctaatttcccttctctgataaagatggacattcacaaaaaagtaactgacccaagtgtggccaaaagcatgatggcttgcctcctgtcttcactgaaggctaatggctcccggggagctttctgtgaagtgagaccagatgataaaagaattctggaattttacagcaagttaggatgttttgaaattgcaaaaatggaaggatttccaaaggatgtggttatacttggtcggagcctgtgacatttgttgacactgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaaaaaatatagtattgcagcaaatcctgtatgaaagagagatgtgggcttccnttttgagtcttgngttangtgctgagaccttttacatgggctnatacagggaaanagtcttcaataaatgtantcnncactattttctgcatccagggnggntgcntttcccncctgaaanaaatcaaaaaancatcggncanctccctggntaatganggaaagccccccancntangggactggcaaaaanaaaaaaaaaaaaatggnttcaaaatgtcngggggangatcccaggggaaggtgggcntnatttaacngaaaaaaatncattggggaatntccgntttnnaanccggccantttccccgnaagacgntggtncggcnntnantttn

SEQ ID NO: 77 - DNA, 534 bp, Human
tactatgagaggtcgcatcaccatcaccatcacggatcctatttaggtgacactatagaatcgtcgactctggaccttggctgtcactcagttcagccctgcctcgccctgctctgctccccttactgttctggcaacccaggccccgagtccaagatctcgcctttctgggtgatgcctcctcccgagcaaaggcccagtgactatggcatccccatggatgtggagatggcctacgtccaggacagcttcctgaccaatgacatccttcacgagatgatgctgctggtggagttctacaagggttcccctgacctcgtgaggctccaggaaccctggagccaggagcacacctacctcgacaagcttaagatctccttggccagcaggacgcccaaggaccagagcctgtgtcacgtcctggaacaggtgtgcggcgtcctcaagcaggggagctgagccttccagggcagggtgggctccagttgtcttgagggtccggatgggctcaggtaataaagaaacggaagcagc

SEQ ID NO: 78 - DNA, 1416 bp, Human
  misc_feature (11)..(11): n is a, c, g, or t
  misc_feature (703)..(703): n is a, c, g, or t
ccccatacccncccctaaggaatactagagaggacgcatcaccatcaccatcacggtcgacccacgcgtccgcccacgcgtccgggaagtgatctgggaatgtctggcaactctgagccaaagaaatgtctgaggaccaggaatgtttcaaagtctctggaaaaattgaaagaattctgctgcgattctgcccttcctcatagtagagtccagacagaatctctgcaggagagatttgcagttctgccaaaatgtactgattttgatgatatcagtcttctacacgcaaagaatgcagtttcttctgaagattcgaaacgtcaaattaatcaaaaggacacaacactttttgatctcagtcagtttggatcatcaaatacaagtcatgaaaatttacagaaaactgcttccaaatcagctaacaaacggtccaaaagcatctatacgccgctagaattacaatacatagaaatgaagcagcagcacaaagatgcagttttgtgtgtggaatgtggatataagtatagattctttggggaagatgcagagattgcagcccgagagctcaatatttattgccatttagatcacaactttatgacagcaagtatacctactcacagactgtttgttcatgtacgccgcctggtggcaaaaggatataaggtgggagttgtgaagcaaactgaaactgcagcattanaggccattggagacaacagaagttcactcttttcccggaaattgactgccctttatacaaaatctacacttattggagaagatgtgaatcccctaatcaagctggatgatgctgtaaatgttgatgagataatgactgatacttctaccagctatcctctgtgcatctctgaaaataaggaaaatgttagggacaaaaaaacgggcacatttttaattggctttggggggaatcgaccctgccacaggccaaggttgggtttgaaaatttccagaaatcctgcttctcgttccaaactaaaaacccgaatgtcaaacttgcaaccaaaaaagttgcggtttccttcgccctttgccgaaacaaaaaaggcgcctccccccaaaccccattctggtttgggccagaataaccaaaattcaaatcaaacgagggaaacctattttattgacacaccccccgtttcaccccactacacagattattttcaaaacaaactgcaactcacaaagcttccccttttcctgccgatccaccttacacaacacgtctccctcatctccaccacctcaccaacacaatcaaacaccctctaacactctcccccacatacttaatctactcacaccccactacacctctacaacataccaccacataacatcacaacaatccatacacccatatattcataccaaccaaacctcacaactacc

SEQ ID NO: 79 - DNA, 1223 bp, Human
  misc_feature (1)..(1): n is a, c, g, or t
  misc_feature (927)..(927): n is a, c, g, or t
  misc_feature (947)..(947): n is a, c, g, or t
  misc_feature (1020)..(1020): n is a, c, g, or t
  misc_feature (1039)..(1039): n is a, c, g, or t
  misc_feature (1041)..(1041): n is a, c, g, or t
  misc_feature (1065)..(1065): n is a, c, g, or t
  misc_feature (1067)..(1067): n is a, c, g, or t
  misc_feature (1078)..(1078): n is a, c, g, or t
  misc_feature (1089)..(1089): n is a, c, g, or t
  misc_feature (1092)..(1092): n is a, c, g, or t
  misc_feature (1094)..(1094): n is a, c, g, or t
  misc_feature (1100)..(1100): n is a, c, g, or t
  misc_feature (1107)..(1107): n is a, c, g, or t
  misc_feature (1110)..(1111): n is a, c, g, or t
  misc_feature (1127)..(1127): n is a, c, g, or t
  misc_feature (1132)..(1132): n is a, c, g, or t
  misc_feature (1134)..(1134): n is a, c, g, or t
  misc_feature (1139)..(1139): n is a, c, g, or t
  misc_feature (1143)..(1143): n is a, c, g, or t
  misc_feature (1146)..(1147): n is a, c, g, or t
  misc_feature (1151)..(1151): n is a, c, g, or t
  misc_feature (1170)..(1170): n is a, c, g, or t
  misc_feature (1174)..(1174): n is a, c, g, or t
  misc_feature (1176)..(1176): n is a, c, g, or t
  misc_feature (1196)..(1197): n is a, c, g, or t
  misc_feature (1204)..(1204): n is a, c, g, or t
  misc_feature (1212)..(1212): n is a, c, g, or t
  misc_feature (1216)..(1217): n is a, c, g, or t
  misc_feature (1220)..(1220): n is a, c, g, or t
naatagagaaaattaactatgagaggatcgcatcaccatcaccatcacggatcctatttaggtgacactatagaatcgtcgacccacgcgtccgcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttgggcaaatttgactggcanagtggtcaacctcacccganagcagtgccaggaatccaagtaaagtcccaagtgaaaacaaggatctgtatgaaatactcatgggtccagggnccctttgcattctaatgananggaaccaactcccccggggggggncnttctaatgcanaaataacccanggncnttgtcncctgccnttnnaactgaatcagggganccctnantgaanaccntannggangaaaacccctggaaaaaancccngnccggaaattttccatccccnncaaaaanttgaattnaatnnccngaa

SEQ ID NO: 80 - DNA, 891 bp, Human
  misc_feature (732)..(732): n is a, c, g, or t
  misc_feature (735)..(736): n is a, c, g, or t
  misc_feature (741)..(742): n is a, c, g, or t
  misc_feature (748)..(748): n is a, c, g, or t
  misc_feature (753)..(753): n is a, c, g, or t
  misc_feature (767)..(767): n is a, c, g, or t
  misc_feature (794)..(794): n is a, c, g, or t
  misc_feature (805)..(805): n is a, c, g, or t
atatatgagaggtcgcatcaccatcacatcacggatcctatttaggtgacactatagaatcgtcgactctggaccttggctgtcactcagttaaggccggctgccaggtggcctctaccatgttggtatggagcaaggatgatggtgtttcctggagcacaccccggaatctctccctggatattggcactgaagtgtttgcccctggaccgggctctggtattcagaaacagcgggagccacggaagggccgcctcatcgtgtgtggccatgggacgctggagcgggacggagtcttctgtctcctcagcgatgatcatggtgcctcctggcgctacggaagtggggtcagcggcatcccctacggtcagcccaagcaggaaaatgatttcaatcctgatgaatgccagccctatgagctcccagatggctcagtcgtcatcaatgcccgaaaccagaacaactaccactgccactgccgaattgtcctccgcagctatgatgcctgtgatacactaaggccccgtgatgtgaccttcgaccctgagctcgtggaccctgtggtagctgcaggagctgtagtcaccagctccggcattgtcttcttctccaacccagcacatccagagttccgagcgaacctgaccctgcgatggagcttcagcaatggtacctcatggcggaaagagacagtccagctatggcccagccccagtggctatttcatcctgncanncctgnnaggcancatgnatggagaagagcangccccccagctctacgtcctgtatganaaaagccgaancactaccagagagcatctcgtggccaaatcagtgtctatggacactctgactgtgcatgcacagggtatctgcctcagatctgctc

SEQ ID NO: 81 - DNA, 1154 bp, Human
  misc_feature (856)..(856): n is a, c, g, or t
  misc_feature (862)..(862): n is a, c, g, or t
  misc_feature (907)..(907): n is a, c, g, or t
  misc_feature (934)..(934): n is a, c, g, or t
  misc_feature (947)..(947): n is a, c, g, or t
  misc_feature (960)..(960): n is a, c, g, or t
  misc_feature (980)..(980): n is a, c, g, or t
  misc_feature (985)..(985): n is a, c, g, or t
  misc_feature (1003)..(1003): n is a, c, g, or t
  misc_feature (1012)..(1012): n is a, c, g, or t
  misc_feature (1014)..(1015): n is a, c, g, or t
  misc_feature (1021)..(1021): n is a, c, g, or t
  misc_feature (1029)..(1029): n is a, c, g, or t
  misc_feature (1043)..(1043): n is a, c, g, or t
  misc_feature (1046)..(1046): n is a, c, g, or t
  misc_feature (1049)..(1049): n is a, c, g, or t
  misc_feature (1058)..(1058): n is a, c, g, or t
  misc_feature (1062)..(1062): n is a, c, g, or t
  misc_feature (1067)..(1067): n is a, c, g, or t
  misc_feature (1072)..(1072): n is a, c, g, or t
  misc_feature (1080)..(1081): n is a, c, g, or t
  misc_feature (1093)..(1093): n is a, c, g, or t
  misc_feature (1111)..(1111): n is a, c, g, or t
  misc_feature (1127)..(1127): n is a, c, g, or t
  misc_feature (1132)..(1133): n is a, c, g, or t
  misc_feature (1137)..(1139): n is a, c, g, or t
  misc_feature (1143)..(1143): n is a, c, g, or t
  misc_feature (1149)..(1149): n is a, c, g, or t
tagagaaattactatgagaggatcgcatcaccatcaccatcacggatcctatttaggtgacactatagaatcgtcgacccacgcgtccggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcattgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaaaaangaaaantgcccgggccgtgcgcctcatcaccctggagaagaaatgaccaantacaagcccgaatccgaagaactgacngcaaaaaggatcncaaaattctgccnccgcttcctggaaggcaaantcaancccccctgatgaaccagnaactgccgnannactggnaaaaacanccctgtcaaggttnttnttnggaaaaaantttnaaaanttggntttttatnnaaaaaaaaaacntttttgggaaattctttncccccagggggggggncccgnnaaannnttgnttcccntttgg

SEQ ID NO: 82 - DNA, 873 bp, Human
  misc_feature (1)..(2): n is a, c, g, or t
  misc_feature (781)..(782): n is a, c, g, or t
  misc_feature (792)..(792): n is a, c, g, or t
nnggaaggatatggaagtgacgtgagaggatgcatcccatcaccatcacggatcctatttaggtgacactatagaatcgtcgactctggaccttggctgtcactcagttagggacatgacctctgtgctgaagcaggatcgggagcggctccgagccatgcagaagcagcagcctcggttttctgaggaccagcggcgggaactgggtgctgtgcactcctgggtccggaagggccaactgcctcgggctcttgatgtgatggcctgtgtggactgtgggagcagcacccaagatcctggtcaccctgatgacccactcttctcagagctggatggactggggctggagcccatggaagagggtggaggcgagcagggcagcagcggtggcggcagtggtgagggagagggctgcgaggaggcccaaggcggggccaaggcttcaagctctcaggacttggctatggaggaggaggaagaaggcaggagctcatccagtccagccttacctacagcaggaaactgcaccagctagactccattctgggaccatctccaggagtccatgagaggctttcttctcctatgtcccaattctcagaactcagatgtggctagaccaaccagtgggaaactgccccagcttctcccaccatagggggccggacccccatcaccagcctaggatccaggggctgcctctggcctcttagggagcagagagcagaactccgcagcccagcccagaggagtgtcacctcccacctttggagagaatccnntcctccctgnacaaagtgctgacagctgctgaagtgcctctcatattcagctgagctgatctgactctgagggtgggctgcactattttat

SEQ ID NO: 83 - DNA, 1338 bp, Human
  misc_feature (991)..(991): n is a, c, g, or t
  misc_feature (1018)..(1018): n is a, c, g, or t
  misc_feature (1024)..(1024): n is a, c, g, or t
  misc_feature (1038)..(1038): n is a, c, g, or t
  misc_feature (1040)..(1040): n is a, c, g, or t
  misc_feature (1056)..(1056): n is a, c, g, or t
  misc_feature (1090)..(1090): n is a, c, g, or t
  misc_feature (1101)..(1101): n is a, c, g, or t
  misc_feature (1125)..(1125): n is a, c, g, or t
  misc_feature (1173)..(1173): n is a, c, g, or t
  misc_feature (1193)..(1193): n is a, c, g, or t
  misc_feature (1197)..(1197): n is a, c, g, or t
  misc_feature (1209)..(1209): n is a, c, g, or t
  misc_feature (1216)..(1216): n is a, c, g, or t
  misc_feature (1221)..(1221): n is a, c, g, or t
  misc_feature (1225)..(1225): n is a, c, g, or t
  misc_feature (1228)..(1228): n is a, c, g, or t
  misc_feature (1242)..(1242): n is a, c, g, or t
  misc_feature (1251)..(1252): n is a, c, g, or t
  misc_feature (1258)..(1258): n is a, c, g, or t
  misc_feature (1260)..(1261): n is a, c, g, or t
  misc_feature (1276)..(1276): n is a, c, g, or t
  misc_feature (1279)..(1279): n is a, c, g, or t
  misc_feature (1281)..(1281): n is a, c, g, or t
  misc_feature (1287)..(1287): n is a, c, g, or t
  misc_feature (1293)..(1293): n is a, c, g, or t
  misc_feature (1303)..(1303): n is a, c, g, or t
  misc_feature (1309)..(1309): n is a, c, g, or t
  misc_feature (1311)..(1311): n is a, c, g, or t
  misc_feature (1328)..(1328): n is a, c, g, or t
  misc_feature (1334)..(1335): n is a, c, g, or t
  misc_feature (1337)..(1338): n is a, c, g, or t
tagagaaattactatgagaggatcgcatcaccatcaccatcacggatcctatttaggtgacactatagaatcgtcgacccacgcgtccggaaagatggcgtcctcggagcaggcagagcagccgagccagccaagctctactccaggaagtgaaaatgtgctgcctcgagagccgctgattgccacggcagtgaagtttctacagaattcccgggtccgccagagcccacttgcaaccaggagagcattcctaaagaagaaagggctgacagatgaagagattgatatggccttccagcagtcgggcactgctgccgatgagccttcgtccttgggcccagccacacaggtggttcctgtccagccccctcacctcatatctcagccatacagtcccgcaggctcccgatggcgagattacggcgccctggccatcatcatggcaggcattgcatttggctttcaccagctctacaagaaatacctgctccccctcatcctgggcggccgagaggacagaaagcagctggagaggatggaggccggtctctctgagctgagtggcagcgtggcccagacagtgactcagttacagacgaccctcgcctccgtccaggagctgctgattcagcagcagcagaagatccaggagcttgcccacgagctggccgctgccaaggccaccacatccaccaactggatcctggagtcccagaatatcaacgaactcaagtccgaaattaactccttgaaagggcttcttttaaatcggaggcagttccctccatccccatcagccccgaagatcccctcctggcagatcccagtcaagtcaccgtcaccctccagccctgcggccgtgaaccaccacagcagcagcgacatctcacctgtcagcaacgagtccacgtcgtcctcgcctgggaaggagggccacagccccgagggctccacggtcacctaccacttgctgggccccaagaagaaggcnaagggggtggtggacgtcaagggccangtgcgnatggaagtgcaagncnagaagaaaaaaaggangacaggaggacaagaggatgagaggatgatgatntgaccctgtgnacaagaagatgcctggggggcaanggagaccccggggcgggatggcaaatcacaacaggggaaaactggggncccaggggcccccaaaaaantaanggaaaagggttncccgttnccccncccnganaagaataaggggcngggggggcnncccgcncnncctgggccggggggnttntnccccangggggnaaatttcccncccggngnggggggggggggaaaantttttnngnn

SEQ ID NO: 84 - DNA, 879 bp, Human
  misc_feature (798)..(798): n is a, c, g, or t
  misc_feature (812)..(812): n is a, c, g, or t
tagagagatactatgagaggacgcatcaccatcaccatcacggatcctatttaggtgacactatagaatcgtcgactctggaccttggctgtcactcagttaagaatggcatctctaagaggacttttgaagaaataaaagaagaaatagccagctgtggagatgttgctaaagcaatcatcaacctagctgtttatggtaaagcccagaacagatcctatgagcgattggcacttctggttgatactgttggacccagactgagtggctccaagaacctagaaaaagccatccaaattatgtaccaaaacctgcagcaagatgggctggagaaagttcacctggagccagtgagaataccccactgggagaggggagaagaatcagctgtgatgctggagccaagaattcataagatagccatcctgggtcttggcagcagcattgggactcctccagaaggcattacagcagaagttctggtggtgacctctttcgatgaactgcagagaagggcctcagaagcaagagggaagattgttgtttataaccaaccttacatcaactactcaaggacggtgcaataccgaacgcagggggcggtggaagctgccaaggttggggctttggcatctctcattcgatccgtggcctccttctccatctacagtcctcacacaggtattcaggaataccaggatggcgtgcccaagattccaacagcctgtattacggtggaagatgcagaaaatgatgtcagaatggcttctcatgggatcaaaatgtcattcagctaangatgggggcaaganctaccagatactgattcctcacactgtagcagagtcactggagcaatatcagaacaggtgtactgtc

SEQ ID NO: 85 - DNA, 875 bp, Human
  misc_feature (733)..(734): n is a, c, g, or t
  misc_feature (833)..(833): n is a, c, g, or t
  misc_feature (848)..(848): n is a, c, g, or t
tatagagagatactatgagaggtcgcatcaccatcaccatcacggatcctatttaggtgacactatagaatcgtcgactctggaccttggctgtcactcagttaagcgcgagctggacgtcgaggtgagccggctggaagccaggctttcggagctggaattccataactccaagtcatccaaggaactagactttctgagggaagagaaccacaaattacagctggagaggcaaaacctgcagctggagacccgaaggctccaatcggaaatcaacatggcagcgacggaaacacgagacctgcggaacatgaccgtggcggactctgggaccaaccatgactccagactgtggtccttggagagggaactggatgacctcaagaggctctccaaggacaaagacctcgagatcgacgagctgcagaagcgcctgggctccgtggccgtcaagcgggagcagcgggagaaccacctgcggcgctccatcgtagtcatccaccctgacacaggccgcgagctgtccccagaggaagcccaccgtgccgggctcattgactggaacatgttcgtgaaactcagaagccaggagtgcgactgggaggagatctcagtgaagggtcccaatggggagtcctcagtgatacacgacaggaagtctggcaagaagttctccatcgaagaggccctgcagagtggcaggctgacccctgctcagtatgaccgctatgtnncacaggatatgtccatccaggagctggcggtcttggtatctgggcagaagtaggcacagctcttgggcactctcgtaacggcagacgctggccctctcntacgacgcgtgaccntcctggtgtcgtcctctcctagccctg

SEQ ID NO: 86 - DNA, 1174 bp, Human
  misc_feature (841)..(841): n is a, c, g, or t
  misc_feature (905)..(905): n is a, c, g, or t
  misc_feature (924)..(924): n is a, c, g, or t
  misc_feature (930)..(930): n is a, c, g, or t
  misc_feature (997)..(997): n is a, c, g, or t
  misc_feature (1010)..(1010): n is a, c, g, or t
  misc_feature (1019)..(1019): n is a, c, g, or t
  misc_feature (1043)..(1043): n is a, c, g, or t
  misc_feature (1061)..(1063): n is a, c, g, or t
  misc_feature (1069)..(1069): n is a, c, g, or t
  misc_feature (1072)..(1072): n is a, c, g, or t
  misc_feature (1080)..(1080): n is a, c, g, or t
  misc_feature (1094)..(1095): n is a, c, g, or t
  misc_feature (1113)..(1113): n is a, c, g, or t
  misc_feature (1123)..(1123): n is a, c, g, or t
  misc_feature (1145)..(1145): n is a, c, g, or t
  misc_feature (1149)..(1149): n is a, c, g, or t
  misc_feature (1154)..(1154): n is a, c, g, or t
  misc_feature (1161)..(1161): n is a, c, g, or t
  misc_feature (1163)..(1163): n is a, c, g, or t
  misc_feature (1166)..(1166): n is a, c, g, or t
  misc_feature (1170)..(1171): n is a, c, g, or t
  misc_feature (1174)..(1174): n is a, c, g, or t
aatagagaaattactatgagaggatcgcatcaccatcaccatcacggatcctatttaggtgacactatagaatcgtcgacccacgcgtccgccaagaacgtgctcttcgctcacctggatgacaacgagaggagtgacatattcgatgccatgttccctgtcactcacatcgctggggagactgttatacagcaagggaatgaaggagacaacttctatgtcgttgatcaaggggaagtggatgtgtacgtgaacggagagtgggtgaccaacatcagcgagggaggcagcttcggggagctggcgctcatctacggcacccccagggctgcgaccgtgaaagccaagacggacctcaagctctgggggatcgaccgggacagctaccggcgcatccttatgggcagcacgctgaggaaacgcaagatgtacgaggagttcctcagcaaggtctccatcctagagtccctggagaagtgggagcgtctgaccgtggcggatgcgctggagcccgtccagtttgaagatggagagaaaattgtggtccagggagagcctggggacgacttttacatcatcacggagggcaccgcgtccgtgctgcagcgccggtcccccaatgaggagtacgtggaggtggggcgcctgggaccctctgactacttcggggagattgcactgctgctgaaccggccccgggcggccactgtcgtggcccgggggcccctcaagtgtgtgaagctggaccggccccgcttcgagcgtgtgctggggccctgctctgagatcctcaagaggaacattcagcgttacaacagcttcatctccctcaccgtctgancacagctcccgccctgcagccccagctccccagtgtggtggccgtgccctgctcgtctgtgtcnggggccccggaaccccctntgtgangtgtgggccgggtggggctgggtcccggcacgtgaggactgccccttccccggactcccttttttgnaataaatgatccnccttgtgcnttttcaaatcaaaagaaaagcggnacaaaatgcctcccaaannnaggaanggnaagggcanttttctcccaaaanncctcccgggttgcctttnggggttttcnttggggggcccccccccccctnccanttccntggaaangnttnaaannggn

SEQ ID NO: 87 - DNA, 959 bp, Human
aactatgagaggtcgcatcaccatcaccatcacggatcctatttaggtgacactatagaatcgtcgacccacgcgtccgcctccttccatctcatctctatctctgggctggtttgtgagctgaaagagttcacacatacctggggtgggcctctgtctcctcgacagagtgggactgaggagcgaggcctgaagcattactggttcacatcctggcccgaccagaagaccccagaccgggcccccccactcctgcacctggtgcgggaggtggaggaggcagcccagcaggaggggccccactgtgcccccatcatcgtccactgcagtgcagggattgggaggaccggctgcttcattgccaccagcatctgctgccagcagctgcggcaggagggtgtagtggacatcctgaagaccacgtgccagctccgtcaggacaggggcggcatgatccagacatgcgagcagtaccagtttgtgcaccacgtcatgagcctctacgaaaagcagctgtcccaccagtccccagaatgactgcgcttctcctacaaggttctctgggcactgcccagcctgagtctcggccctcacccagggccctgcctcgggtcctgggcctgctccccgcttcctccccttcagtcagctccctctgtcctctgtcagcctggcctgacccctaccctccagcattgctcttcctactgtacatattggggagtggggggcagggtcgggaagggacatgccaggccaggcctggggccccggggcctgacccacaccacgcagaccccgggctccagtttttaacgatggttccatcaatacctgatccagaatgtttccgtgctacactttgtgtcctgctgcaatgtgttctgtctgtccatccatctctgccctctgtaccggacactgtgtctcctcagccaggaaaggggtaatgagctcca

SEQ ID NO: 88 - DNA, 1105 bp, Human
  misc_feature (774)..(774): n is a, c, g, or t
  misc_feature (800)..(800): n is a, c, g, or t
  misc_feature (830)..(830): n is a, c, g, or t
  misc_feature (848)..(848): n is a, c, g, or t
  misc_feature (855)..(855): n is a, c, g, or t
  misc_feature (857)..(857): n is a, c, g, or t
  misc_feature (915)..(915): n is a, c, g, or t
  misc_feature (925)..(926): n is a, c, g, or t
  misc_feature (934)..(934): n is a, c, g, or t
  misc_feature (943)..(943): n is a, c, g, or t
  misc_feature (946)..(946): n is a, c, g, or t
  misc_feature (949)..(949): n is a, c, g, or t
  misc_feature (952)..(952): n is a, c, g, or t
  misc_feature (961)..(961): n is a, c, g, or t
  misc_feature (983)..(983): n is a, c, g, or t
  misc_feature (993)..(993): n is a, c, g, or t
  misc_feature (996)..(996): n is a, c, g, or t
  misc_feature (1007)..(1007): n is a, c, g, or t
  misc_feature (1011)..(1011): n is a, c, g, or t
  misc_feature (1015)..(1015): n is a, c, g, or t
  misc_feature (1019)..(1019): n is a, c, g, or t
  misc_feature (1023)..(1023): n is a, c, g, or t
  misc_feature (1025)..(1025): n is a, c, g, or t
  misc_feature (1029)..(1029): n is a, c, g, or t
  misc_feature (1036)..(1036): n is a, c, g, or t
  misc_feature (1038)..(1038): n is a, c, g, or t
  misc_feature (1045)..(1045): n is a, c, g, or t
  misc_feature (1058)..(1058): n is a, c, g, or t
  misc_feature (1063)..(1063): n is a, c, g, or t
  misc_feature (1068)..(1068): n is a, c, g, or t
  misc_feature (1073)..(1073): n is a, c, g, or t
  misc_feature (1078)..(1078): n is a, c, g, or t
  misc_feature (1091)..(1091): n is a, c, g, or t
  misc_feature (1102)..(1104): n is a, c, g, or t
attagagaaattactatgagaggatcgcatcaccatcaccatcacggatcctatttaggtgacactatagaatcgtcgacccacgcgtccggtcgccgatcccgccggaagcgccaggacaatggggacccgggacgacgagtacgactacctattcaaagtggtgctcatcggggactcaggcgtgggcaagagcaacctgctgtcgcgcttcacccgcaacgagttcaacctggagagcaagagcaccatcggcgtggagttcgccacccgcagcatccaggtggacggcaagaccatcaaggcgcagatctgggacaccgctggccaggagcgctaccgcgccatcacctccgcgtactaccgtggtgcagtgggcgccctgctggtgtacgacatcgccaagcacctgacctatgagaacgtggagcgctggctgaaggagctgcgggaccacgcagacagcaacatcgtcatcatgctggtgggcaacaagagtgacctgcgccacctgcgggctgtgcccactgacgaggcccgcgccttcgcagaaaagaacaacttgtccttcatcgagacctcagccttggattccactaacgtagaggaagcattcaagaacatcctcacaggtggccggggaccagatgggtgtgggtagggcaccagccaggcagggtggaacacggcctctgaaccttcgcttgttttgttcgtttgcttgtttttttcttttttttgtcggggcaggatggagttttgctctttgcccangctggagtgtggtggctcgatctcancttactgcaacctccgccttccaggttcangcaattctcctgcctcancctcccnantaactgggattacaggtgcctgccaccacacccgctaatttttgtaattttaataaanacaggatttnncaatgttntccaggttnatntcnaantccttgggntcaagtgatcctcttgcctcancctcccaaantgntgggaattaangggnggancccntgcncntggnctgtttnanttttttnccccccccccccntaacntttgnttttnaaacntgccgggtccccntggaaactttnnna

SEQ ID NO: 89 - DNA, 1930 bp, Human
atggcaggcggtgcaggttggtctggtgcaccggcagcactgctgcgtagcgttcgtcgtctgcgtgaagtttttgaagtttgtggtcgtgatccggatggttttctgcgtgttgaacgtgttgcagcactgggtctgcgttttggtcagggtgaagaagtggaaaaactggttaaatatctggacccgaatgatctgggtcgcatcaactttaaagatttttgccgtggcgtttttgcaatgaaaggttgcgaagaactgctgaaagatgttctgagcgttgaaagcgctggaaccctgccttgtgctcctgaaattccggattgtgttgaacagggtagcgaagttaccggtccgacctttgcagatggtgaactgattccgcgtgaaccgggtttttttccggaagatgaagaggaagcaatgaccctggcacctcctgaaggtccgcaggaactgtataccgatagcccgatggaaagcacccagagcctggaaggtagcgttggttctccggcagaaaaagatggtggtctgggtggcctgtttctgccggaagataaaagcctggttcataccccgagcatgaccacctctgatctgagcacccatagcaccacctcactgattagcaacgaagaacagtttgaagattatggcgaaggtgatgatgttgattgtgcaccgagcagcccgtgtccggatgatgaaacccgtaccaatgtttatagcgatctgggtagcagcgttagcagcagcgcaggtcagacaccgcgtaaaatgcgtcatgtgtataatagcgaactgctggatgtttattgtagccaatgctgcaaaaaaattaacctgctgaatgatctggaagcacgcctgaaaaatctgaaagcaaatagcccgaatcgtaaaatcagcagcaccgcatttggtcgtcagctgatgcatagcagcaattttagcagcagcaatggtagcaccgaggacctgtttcgtgatagcattgatagctgcgataacgatattaccgaaaaagtgagcttcctggaaaaaaaagtgaccgaactggaaaatgatagcctgaccaatggtgatctgaaaagcaaactgaaacaggaaaatacccagctggttcatcgtgttcatgaactggaagaaatggtgaaagatcaggaaaccaccgcagaacaggcactggaagaagaagcacgtcgtcaccgcgaagcatatggtaaactggaacgtgaaaaagcaaccgaagttgaactgctgaatgcacgtgttcaacaactggaagaagagaataccgaactgcgtaccaccgttacccgtctgaaaagccagaccgaaaaactggatgaagaacgtcagcgtatgagcgatcgtctggaagataccagcctgcgtctgaaagatgagatggatctgtataaacgcatgatggataaactgcgtcagaatcgcctggaatttcagaaagaacgtgaagcaacccaggaactgattgaagatctgcgcaaagaactggaacatctgcaaatgtataaactggattgtgaacgtccgggtcgtggtcgtagcgcaagcagcggtctgggtgaatttaatgcacgtgctcgtgaagttgagctggaacatgaagttaaacgcctgaaacaagaaaactataaactgcgcgatcagaatgatgatctgaatggtcagattctgagcctgagcctgtatgaagcaaaaaacctgtttgcagcacagaccaaagcacagagcctggcagcagaaattgataccgcaagccgtgatgaactgatggaagcactgaaagaacaggaagaaattaattttcgcctgcgccagtatatggataaaattatcctggccattctggatcataatccgagcatcctggaaatcaaacactaagcggccgcttaattaa

SEQ ID NO: 90 - DNA, 1249 bp, Human
  misc_feature (790)..(790): n is a, c, g, or t
  misc_feature (824)..(824): n is a, c, g, or t
  misc_feature (837)..(837): n is a, c, g, or t
  misc_feature (846)..(846): n is a, c, g, or t
  misc_feature (859)..(859): n is a, c, g, or t
  misc_feature (864)..(864): n is a, c, g, or t
  misc_feature (911)..(911): n is a, c, g, or t
  misc_feature (923)..(923): n is a, c, g, or t
  misc_feature (925)..(925): n is a, c, g, or t
  misc_feature (936)..(936): n is a, c, g, or t
  misc_feature (959)..(959): n is a, c, g, or t
  misc_feature (973)..(973): n is a, c, g, or t
  misc_feature (984)..(984): n is a, c, g, or t
  misc_feature (990)..(990): n is a, c, g, or t
  misc_feature (1001)..(1001): n is a, c, g, or t
  misc_feature (1003)..(1003): n is a, c, g, or t
  misc_feature (1009)..(1010): n is a, c, g, or t
  misc_feature (1015)..(1015): n is a, c, g, or t
  misc_feature (1017)..(1017): n is a, c, g, or t
  misc_feature (1021)..(1021): n is a, c, g, or t
  misc_feature (1027)..(1028): n is a, c, g, or t
  misc_feature (1034)..(1034): n is a, c, g, or t
  misc_feature (1038)..(1038): n is a, c, g, or t
  misc_feature (1045)..(1045): n is a, c, g, or t
  misc_feature (1053)..(1053): n is a, c, g, or t
  misc_feature (1061)..(1061): n is a, c, g, or t
  misc_feature (1076)..(1076): n is a, c, g, or t
  misc_feature (1092)..(1092): n is a, c, g, or t
  misc_feature (1096)..(1096): n is a, c, g, or t
  misc_feature (1100)..(1100): n is a, c, g, or t
  misc_feature (1130)..(1130): n is a, c, g, or t
  misc_feature (1142)..(1142): n is a, c, g, or t
  misc_feature (1151)..(1151): n is a, c, g, or t
  misc_feature (1166)..(1166): n is a, c, g, or t
  misc_feature (1168)..(1168): n is a, c, g, or t
  misc_feature (1175)..(1175): n is a, c, g, or t
  misc_feature (1181)..(1181): n is a, c, g, or t
  misc_feature (1204)..(1206): n is a, c, g, or t
  misc_feature (1223)..(1223): n is a, c, g, or t
  misc_feature (1228)..(1228): n is a, c, g, or t
  misc_feature (1231)..(1231): n is a, c, g, or t
  misc_feature (1240)..(1240): n is a, c, g, or t
  misc_feature (1244)..(1244): n is a, c, g, or t
gagaaaattactatgagaggatcgcatcaccatcaccatcacggatcctatttaggtgacactatagaatcgtcgacccacgcgtccgtgacggacgaggaggagcggcacagcgccgagagcagcacgagcgaggacaactcgcccgagcacccgtacctcccgctcgtcaccgacgaggacagctggtacagcaagtggcacaagatggagcagaagttccgcatcgtctacgcgcagaagggctacctggaggagctggtgcgtctgcgcgagtcgcagctgaaggacctggaggcggagaaccggcggcttcagctgcagctggaggaggcggcggcgcagaaccagcgcgagaaacgggagctggaaggcgtgatcctggagctgcaggagcagctgacaggtctgatccccagtgaccacgcccctctggcccagggttccaaggagctcactacacccctggtcaatcaatggccctcactgggaacgcttaatggggccgagggcgccagcaactccaagctctaccggagacacagcttcatgagcacggagccgctgtcagctgaagccagtctgagctcggactcccagcgcctgggagagggcacgcgggacgaggagccctggggtcccatcgggaaggaccccacgccctccatgctgggcctctgcggctccctggcctccattcccagctgcaagtccctggcgagcttcaaatccaacgagtgcctggtgagcgacagtcccgagggcagcccagcactgagccccagctgangaacagcatgggcagtgccagccccacctgccangggcccatggaanacctgccancttttttttcaanaaganttcccccaattccaggctaccccttccaaaagaacgctacccaaccnagccaggggttntnttcggggaaanatctcgtctggctcaccttaacntttctgcctttggnaagcaccggcntgcggnaaaaaaaaacncncttggnncaagnangcangggttnncccaanccanaaggaancccccctngggggaanccttgtttccatttntttctggtggaacttngggntttncttttaattttttttccccttgcccccttnaagaaatggggngggcccaanttttcaaaacccccncnttccaantttttnaaccctctccattttttttggtnnnggcctgaaaattatttnttttnttnaacccccangggnaaaaa

SEQ ID NO: 91 - DNA, 926 bp, Human
  misc_feature (278)..(278): n is a, c, g, or t
  misc_feature (485)..(485): n is a, c, g, or t
  misc_feature (803)..(803): n is a, c, g, or t
  misc_feature (827)..(827): n is a, c, g, or t
  misc_feature (829)..(829): n is a, c, g, or t
  misc_feature (862)..(862): n is a, c, g, or t
  misc_feature (865)..(865): n is a, c, g, or t
  misc_feature (870)..(870): n is a, c, g, or t
  misc_feature (878)..(878): n is a, c, g, or t
  misc_feature (904)..(904): n is a, c, g, or t
  misc_feature (906)..(906): n is a, c, g, or t
  misc_feature (909)..(909): n is a, c, g, or t
  misc_feature (921)..(922): n is a, c, g, or t
  misc_feature (925)..(925): n is a, c, g, or t
attagagaaaattactatgagaggatcgcatcaccatcaccatcacggatcctatttaggtgacactatagaatcgtcgacccacgcgtccgcacagccgcaccccaataccgtctaccagtacggggacatggaggtgaagcagctggacaagcgggcctcaggccagagcttcgaggtcatcctcaagtccccttctgacctgtccccagagagccctatgctctcctccccacccaagaagaaggacacctccctggaggagctgcaaaagcggntggaggcagccgaggagcggaggaagacgcaggaggcgcaggtgctgaagcagctggcggagcggcgcgagcacgagcgcgaggtgctgcacaaggcgctggaggagaataacaacttcagccgccaggcggaggagaagctcaactacaagatggagctcagcaaggagatccgcgaggcacacctggccgcactgcgcgagcggntgcgcgagaaggagctgcacgcggccgaggtgcgcaggaacaaggagcagcgagaagagatgtcgggctaagggcccgggacgggcggcgcccatcctgcgacggaacacgttcgggttttggttttgtttcgttcacctctgtctagatgcaacttttgttcctcctcccccaccccagcccccagcttcatgcttctcttccgcactcagccgccctgccctgtcctcgtggtgagtcgctgaccacggcttcccctgcaggagccgccgggcgtgagacgcggtccctcggtgcagacaccaggccgggcgcggntgggtcccccgggggccctgtgananaggtggcggtgaccgtggtaaacccagggcggnggngtggnatcgcggntccttacgctgggtttgtctggtcancncgngcaggtcagggnnagnt

SEQ ID NO: 92 - DNA, 614 bp, Human
  misc_feature (1)..(1): n is a, c, g, or t
  misc_feature (3)..(3): n is a, c, g, or t
  misc_feature (352)..(352): n is a, c, g, or t
  misc_feature (360)..(360): n is a, c, g, or t
  misc_feature (371)..(371): n is a, c, g, or t
  misc_feature (415)..(415): n is a, c, g, or t
  misc_feature (425)..(425): n is a, c, g, or t
  misc_feature (442)..(443): n is a, c, g, or t
  misc_feature (446)..(446): n is a, c, g, or t
  misc_feature (475)..(475): n is a, c, g, or t
  misc_feature (479)..(479): n is a, c, g, or t
  misc_feature (486)..(487): n is a, c, g, or t
  misc_feature (496)..(497): n is a, c, g, or t
  misc_feature (512)..(512): n is a, c, g, or t
  misc_feature (522)..(522): n is a, c, g, or t
  misc_feature (535)..(536): n is a, c, g, or t
  misc_feature (539)..(539): n is a, c, g, or t
  misc_feature (558)..(558): n is a, c, g, or t
  misc_feature (568)..(569): n is a, c, g, or t
  misc_feature (573)..(573): n is a, c, g, or t
  misc_feature (575)..(575): n is a, c, g, or t
  misc_feature (591)..(591): n is a, c, g, or t
  misc_feature (593)..(593): n is a, c, g, or t
  misc_feature (598)..(601): n is a, c, g, or t
  misc_feature (609)..(610): n is a, c, g, or t
  misc_feature (612)..(612): n is a, c, g, or t
ntngagaaattactatgagaggatcgcatcaccatcaccatcacggatcctatttaggtgacactatagaatcgtcgacccacgcgtccgtgaataagtcgtcctacaaatatgaagcagacacggtggacctgaattggtgcgtcatttccgacatggaagtcatcgagctgaacaaatgcacctcgggccaatcctttgaagtcatcctgaagccaccctcctttgatggggttcccgagttcaacgcctccctgccaaggcggcgagacccatccctggaagagatccagaagaaactagaagcggctgaggagcgaaggaagtaccaggaagcggagctcctgaaccncttagcanagaaacgggancatgagagagagtgatccaaaggccattgaggaaaacacaactncttcagatgntaaagaaaaactggccnnaanatggattccaccaggaaacgggaggcccnctcnccccctnnttgaaacgnngcaaaaaaggaaaanccccccaagnggggggaaaaaannggncctttaaggaaaaaggccncccggttaanncctnanggcccaaaaaattttncnggttnnnnggggaaanntncc

SEQ ID NO: 93 - DNA, 828 bp, Human
  misc_feature (3)..(3): n is a, c, g, or t
  misc_feature (695)..(695): n is a, c, g, or t
  misc_feature (738)..(738): n is a, c, g, or t
  misc_feature (741)..(741): n is a, c, g, or t
ttnagaggagaattaactatgagaggatcgcatcaccatcaccatcacggatcctatttaggtgacactatagaatcgtcgacccacgcgtccggcaaaactgaacaggacctggcacttggaactgatgcagaaggacagaaggtgaaagattccatgcgagtactccttccagttctactcaacaaaaatcatgataattgtgataaaataagagcaattctactttatatcttcagtattaatggaactacggaagaaaatttggacaggttgatccagaatgtaaagatagaaaatgagagtgacatgattcgtaactggagttaccttggtgttcccattgttccccaatctcaacaaggcaaaccgttaagaaaggatcggtctgcagaagaaacttttcagctctctcggtggacaccttttatcaaagatattatggaggatgctattgataatagattagattcaaaagaatggccatattgttcccagtgtccagcagtatggaatggttcaggagctgtaagtgctcgccagaaacccagagctaattatttagaagaccgaaaaaatgggtcaaagctgattgtttttgtaattggagggatcacatactctgaagtgcgttgtgcttatgaagtttctcaggcacataaatcctgtgaagttattattggttctacacatgntttaacacccaaaaagctgttggatgatataaagatgctgaanaancccaaggataaagtctccttaattaaagatgaatagcgtttctttttggagggtttagagattcttactaatatgttgaactaaaat

SEQ ID NO: 94 - DNA, 900 bp, Human
  misc_feature (633)..(634): n is a, c, g, or t
  misc_feature (649)..(649): n is a, c, g, or t
  misc_feature (730)..(731): n is a, c, g, or t
  misc_feature (773)..(773): n is a, c, g, or t
  misc_feature (813)..(813): n is a, c, g, or t
  misc_feature (857)..(858): n is a, c, g, or t
  misc_feature (881)..(881): n is a, c, g, or t
  misc_feature (885)..(885): n is a, c, g, or t
aatactatgagaggtcgcatcaccatcaccatcacggatcctatttaggtgacactatagaatcgtcgactctggaccttggctgtcactcagttaaggagagaatttctgccctgaacttgcagattgaagaagagaagaacaaacagagacagctgaggttggcattcgaggaacagctggaagatctgatgggccagcacaaggacctctgggacttccatatgccagagcggctggcaaaggagatttgtgccctggacagcagcaaggagcagctgctcaaggaagagaagctggtcaaggcgacactggaagacgtgaagcatcagctgtgctccctgtgtgggactgagggcccctccacccttgatgagggactctttctccgcagccaggaggctgcagccacagtgcagctgtttcaggaagagcacaggaaggctgaggagctcctagcagctgctgcccagcgccaccagcagctgcagcagaagtgccaacaacagcagcagaagcggcagaggctgaaggaagagctggaaaagcatggaatgcaagtccctgcccaagcccagagcacacaagaggaagaggctggcccaggagatgtggccagtcccaagcccctannaggagaaagacctgnagctgcacaccaagcagggcctgatgtcctcataggccaggaggacacactccaccccgaccttagcccaggggctttcanngaaataaggagctattttgatacagctagtctactggtgagnagttagggtcagggcccagatccccagtctctgtgactgnatgaagccttgctttgactctgctctggtctgggccaaagtacnntcacagttttcaataatgctccntaanctcaaaaaaaaaaaa

SEQ ID NO: 95 - DNA, 991 bp, Human
  misc_feature (666)..(666): n is a, c, g, or t
  misc_feature (724)..(724): n is a, c, g, or t
  misc_feature (744)..(744): n is a, c, g, or t
  misc_feature (793)..(793): n is a, c, g, or t
  misc_feature (812)..(812): n is a, c, g, or t
  misc_feature (833)..(833): n is a, c, g, or t
  misc_feature (842)..(842): n is a, c, g, or t
  misc_feature (853)..(853): n is a, c, g, or t
  misc_feature (867)..(867): n is a, c, g, or t
  misc_feature (886)..(886): n is a, c, g, or t
  misc_feature (891)..(891): n is a, c, g, or t
  misc_feature (926)..(926): n is a, c, g, or t
  misc_feature (928)..(928): n is a, c, g, or t
  misc_feature (930)..(930): n is a, c, g, or t
  misc_feature (945)..(945): n is a, c, g, or t
  misc_feature (947)..(947): n is a, c, g, or t
  misc_feature (950)..(950): n is a, c, g, or t
  misc_feature (955)..(955): n is a, c, g, or t
  misc_feature (960)..(960): n is a, c, g, or t
  misc_feature (968)..(968): n is a, c, g, or t
  misc_feature (971)..(971): n is a, c, g, or t
  misc_feature (976)..(978): n is a, c, g, or t
  misc_feature (981)..(981): n is a, c, g, or t
  misc_feature (985)..(985): n is a, c, g, or t
  misc_feature (987)..(987): n is a, c, g, or t
  misc_feature (989)..(989): n is a, c, g, or t
  misc_feature (991)..(991): n is a, c, g, or t
attagagaaattactatgagaggatcgcatcaccatcaccatcacggatcctatttaggtgacactatagaatcgtcgacccacgcgtccgcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatganagggtgtccgtgccgctgctgaagacgctggaccacgtgctcacccacggctgcttcnacatcttcaccacggaggangaccacccctttgctgtgaattgcttgcgctctgtaaaaaaaaatcaanaattcaaaaagatatccanaactcctgtcaggcatcgcantgttctgcnaaatggtgcanttcccccggcgacntgaggaggcaggccctccntgcantgtgtctgctcctctgccaccgtttcccgctgatncngnaaaaccacggccaancnagntgtanaaaanattgctcnccntaaannnacntctngncncn

SEQ ID NO: 96 - DNA, 890 bp, Human
ctatgagaggatcgcatcaccatcaccatcacggtcgacccacgcgtccgcccacgcgtccggcaaccctgggatcccagacatcgtcgtgggagaaattagagaagaatctttctgataggcttggtgaatcccagaccttgctggcagcagcagttgagagagaacgtgcagctacagaagaactccttgctaacaaaattcagatgtcttccatggagtcacagaattctcttttaagacaggaaaacagtagatttcaagcccagctagaatcagagaaaaataggctgtgtaaactggaggatgagaacaataggtaccaggttgaattggaaaacctaaaagatgaatatgtaagaacacttgaagagacgaggaaagaaaagacattgttgaatagtcagttagaaatggaaagaatgaaagttgaacaagaaaggaagaaagccatttttactcaagaaacaataaaagaaaaggaacgcaagccattttctgtttctagcactcccaccatgtcacgctcaagttcaataagtggtgttgatatggcaggactacagacatcttttctgtctcaggatgagtctcatgatcactcatttggaccaatgcctatatcagcaaatggaagcaatctttatgatgctgtaaggatgggagcaggatcaagcataattgaaaacctacagtctcagctaaagctaagggaaggggaaatcactcatttacagctagaaattggcaatctagaaaaaactcgatcaataatggctgaagaactagttaaattaacaaatcaaaatgatgaacttgaagagaaaggtgaaggagatacccaaacttagaactcagctaagagatttggatcaaaggtacaacactat

SEQ ID NO: 97 - DNA, 1315 bp, Human
  misc_feature (827)..(827): n is a, c, g, or t
  misc_feature (883)..(883): n is a, c, g, or t
  misc_feature (900)..(900): n is a, c, g, or t
  misc_feature (926)..(926): n is a, c, g, or t
  misc_feature (954)..(954): n is a, c, g, or t
  misc_feature (970)..(970): n is a, c, g, or t
  misc_feature (977)..(977): n is a, c, g, or t
  misc_feature (1000)..(1000): n is a, c, g, or t
  misc_feature (1014)..(1014): n is a, c, g, or t
  misc_feature (1020)..(1020): n is a, c, g, or t
  misc_feature (1038)..(1038): n is a, c, g, or t
  misc_feature (1059)..(1059): n is a, c, g, or t
  misc_feature (1073)..(1074): n is a, c, g, or t
  misc_feature (1077)..(1077): n is a, c, g, or t
  misc_feature (1088)..(1088): n is a, c, g, or t
  misc_feature (1090)..(1090): n is a, c, g, or t
  misc_feature (1094)..(1094): n is a, c, g, or t
  misc_feature (1107)..(1107): n is a, c, g, or t
  misc_feature (1110)..(1110): n is a, c, g, or t
  misc_feature (1121)..(1121): n is a, c, g, or t
  misc_feature (1127)..(1127): n is a, c, g, or t
  misc_feature (1133)..(1133): n is a, c, g, or t
  misc_feature (1137)..(1137): n is a, c, g, or t
  misc_feature (1147)..(1147): n is a, c, g, or t
  misc_feature (1154)..(1154): n is a, c, g, or t
  misc_feature (1157)..(1157): n is a, c, g, or t
  misc_feature (1159)..(1159): n is a, c, g, or t
  misc_feature (1180)..(1181): n is a, c, g, or t
  misc_feature (1183)..(1183): n is a, c, g, or t
  misc_feature (1205)..(1205): n is a, c, g, or t
  misc_feature (1211)..(1211): n is a, c, g, or t
  misc_feature (1215)..(1215): n is a, c, g, or t
  misc_feature (1227)..(1227): n is a, c, g, or t
  misc_feature (1234)..(1234): n is a, c, g, or t
  misc_feature (1240)..(1240): n is a, c, g, or t
  misc_feature (1276)..(1276): n is a, c, g, or t
  misc_feature (1279)..(1279): n is a, c, g, or t
  misc_feature (1286)..(1286): n is a, c, g, or t
  misc_feature (1295)..(1295): n is a, c, g, or t
  misc_feature (1297)..(1298): n is a, c, g, or t
  misc_feature (1300)..(1300): n is a, c, g, or t
  misc_feature (1303)..(1315): n is a, c, g, or t
agagaaattactatgagaggatcgcatcaccatcaccatcacggatcctatttaggtgacactatagaatcgtcgacccacgcgtccgcaccagtgcgcccgccggagggtgtttatcgcggctagagagatgtcgctgctgcggtcgctgcgcgtgtttctggtcgcgcggaccgggagctacccggctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacaggcagagatctggctccacaaggaggcccagaaggagggctggagcaaagctgccaagctccaagggaggaagaccaaagaaggcctgattgggctgttgcaggaaggaaacacaactgtattagtagaggtaaactgtgagacagattttgtttctagaaatttaaaatttcaactgttggtccagcaagtagcccttggaaccatgatgcattgtcagaccctaaaggatcaaccctctgcatacagtaaaggtttcttgaattcctctgagctttctggacttccagctgggcctgacagagaaggctcactcaaggatcagttggctttagcaattggaaaactgggagaaaacatgattcttaaacgagctgcatgggtgaaggtgccatctgggttctacgttggctcttatgtccacggagcaatgcagagtccctcacttcacaagctggtgctggggnaagtatgggggccctggtcatctgtgagacgtctgaacagaaaacaaaccttgaanacgttggccgccccccnttgggcaaccatgtggtgggcatggncccccctctctgttggctccctggaacnaatgaaccctgggggnaaaggcnaaaaaataaaaatgctgtcccanccgtattttgctgnatcccnccattaccttgggggcantatgtgcaaccctcagggggngtcggtaagaaaannttnggcggtttgantntggnaaaaggtgaaaangcnccaaaaacttnaaaagnttcccnaaanttttggcccnaagaagnaananttacttttaacccccgggacnncnttacaaaaagggaattttcccnaacccncttncaaccgaaaagncgggggnaaaatnttaaaaaaattgtaaaaaaaaaaaaattttttcttnttnggccccnaaaaaaaanannanaannnnnnnnnnnnn

SEQ ID NO: 98 - DNA, 1127 bp, Human
  misc_feature (1)..(1): n is a, c, g, or t
  misc_feature (3)..(3): n is a, c, g, or t
  misc_feature (898)..(898): n is a, c, g, or t
  misc_feature (911)..(911): n is a, c, g, or t
  misc_feature (922)..(922): n is a, c, g, or t
  misc_feature (958)..(958): n is a, c, g, or t
  misc_feature (968)..(968): n is a, c, g, or t
  misc_feature (972)..(972): n is a, c, g, or t
  misc_feature (980)..(980): n is a, c, g, or t
  misc_feature (986)..(986): n is a, c, g, or t
  misc_feature (989)..(989): n is a, c, g, or t
  misc_feature (998)..(998): n is a, c, g, or t
  misc_feature (1000)..(1000): n is a, c, g, or t
  misc_feature (1005)..(1005): n is a, c, g, or t
  misc_feature (1020)..(1020): n is a, c, g, or t
  misc_feature (1025)..(1026): n is a, c, g, or t
  misc_feature (1030)..(1030): n is a, c, g, or t
  misc_feature (1032)..(1032): n is a, c, g, or t
  misc_feature (1039)..(1039): n is a, c, g, or t
  misc_feature (1045)..(1045): n is a, c, g, or t
  misc_feature (1059)..(1059): n is a, c, g, or t
  misc_feature (1063)..(1063): n is a, c, g, or t
  misc_feature (1074)..(1074): n is a, c, g, or t
  misc_feature (1081)..(1081): n is a, c, g, or t
  misc_feature (1102)..(1102): n is a, c, g, or t
  misc_feature (1107)..(1107): n is a, c, g, or t
  misc_feature (1117)..(1120): n is a, c, g, or t
  misc_feature (1122)..(1122): n is a, c, g, or t
nantagagaaattactatgagaggatcgcatcaccatcaccatcacggatcctatttaggtgacactatagaatcgtcgacccacgcgtccgtggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaataaaangcaggcagcatcncactggggtcnctgacagacttgaagctgacatttggcagggcatcnaagggatgcntccntgaagtcnccatcncancccctgtgnangcggngatgaaccactgtcnaatcnntttnanctgaccnttcctngggaatttcttatncccntgtcagtttcnagggtgnaatttttttctttttcccccnggggntaaggaattnnnnangaaaa

SEQ ID NO: 99 - DNA, 948 bp, Human
  misc_feature (2)..(2): n is a, c, g, or t
  misc_feature (4)..(12): n is a, c, g, or t
  misc_feature (16)..(16): n is a, c, g, or t
  misc_feature (21)..(21): n is a, c, g, or t
  misc_feature (23)..(23): n is a, c, g, or t
  misc_feature (30)..(30): n is a, c, g, or t
  misc_feature (41)..(41): n is a, c, g, or t
  misc_feature (45)..(45): n is a, c, g, or t
  misc_feature (59)..(59): n is a, c, g, or t
  misc_feature (62)..(62): n is a, c, g, or t
  misc_feature (383)..(383): n is a, c, g, or t
  misc_feature (587)..(587): n is a, c, g, or t
  misc_feature (750)..(750): n is a, c, g, or t
  misc_feature (822)..(822): n is a, c, g, or t
  misc_feature (847)..(848): n is a, c, g, or t
  misc_feature (866)..(866): n is a, c, g, or t
  misc_feature (876)..(877): n is a, c, g, or t
  misc_feature (887)..(887): n is a, c, g, or t
  misc_feature (891)..(891): n is a, c, g, or t
  misc_feature (896)..(896): n is a, c, g, or t
  misc_feature (912)..(912): n is a, c, g, or t
  misc_feature (917)..(917): n is a, c, g, or t
  misc_feature (925)..(925): n is a, c, g, or t
  misc_feature (930)..(930): n is a, c, g, or t
  misc_feature (932)..(932): n is a, c, g, or t
  misc_feature (936)..(936): n is a, c, g, or t
  misc_feature (942)..(942): n is a, c, g, or t
  misc_feature (944)..(944): n is a, c, g, or t
tntnnnnnnnnncctnctcgngnattatcntatgtagaggntcgnatcaccatcaccantcncgggatcctatttaggtgacactatagaatcgtcgacccacgcgtccgccggaccgcatctccccccacgggggtcggtgcctggggatcctgtccgcatccactgcaacatctggtcggtggagtctgatgaccctaacttggctgctgtcttggagaggctggtggacataaagaaagggaatactctgctattgcagcatctgaagaggatcatctccgacctgtgtaaactctataacctccctcagcatccagatgtggagatgctggatcaacccttgccagcagagcagtgcacacaggaagacgtgtcttcanaagatgaagatgaggagatgcctgaggacacagaagacttagatcactatgaaatgaaagaggaagagccagctgagggcaagaaatctgaagatgatggcattggaaaagaaaacttggccatcctagagaaaattaaaaagaaccagaggcaagattacttaaatggtgcagtgtctggctcggtgcaggccactgaccggntgatgaaggagctcagggatatataccgatcacagagtttcaaaggcggaaactatgcagtcgaactcgtgaatgacagtctgtatgattggaatgtcaaactcctcaaagttgaccaggacagcgctttgcacaacgatctccagatcctcaaagagaaaanaaggagccgactttcattctactttaacttttcctttaaagaaaacttttcccttttgacccaccatttgtncaggggtttgtgtctccagtccctnntctggaggggtatgtttnttggggcggnngggccccatnctgncatgnaaaactttctcacccnaaaanaggggctnggaancnaagngccctncntccc

SEQ ID NO: 100 - DNA, 1179 bp, Human
  misc_feature (2)..(2): n is a, c, g, or t
  misc_feature (891)..(891): n is a, c, g, or t
  misc_feature (901)..(901): n is a, c, g, or t
  misc_feature (921)..(921): n is a, c, g, or t
  misc_feature (937)..(937): n is a, c, g, or t
  misc_feature (967)..(967): n is a, c, g, or t
  misc_feature (971)..(971): n is a, c, g, or t
  misc_feature (1001)..(1001): n is a, c, g, or t
  misc_feature (1018)..(1018): n is a, c, g, or t
  misc_feature (1021)..(1021): n is a, c, g, or t
  misc_feature (1036)..(1036): n is a, c, g, or t
  misc_feature (1042)..(1042): n is a, c, g, or t
  misc_feature (1050)..(1051): n is a, c, g, or t
  misc_feature (1054)..(1054): n is a, c, g, or t
  misc_feature (1074)..(1075): n is a, c, g, or t
  misc_feature (1080)..(1080): n is a, c, g, or t
  misc_feature (1093)..(1093): n is a, c, g, or t
  misc_feature (1100)..(1100): n is a, c, g, or t
  misc_feature (1121)..(1121): n is a, c, g, or t
  misc_feature (1126)..(1126): n is a, c, g, or t
  misc_feature (1140)..(1140): n is a, c, g, or t
  misc_feature (1142)..(1142): n is a, c, g, or t
  misc_feature (1154)..(1154): n is a, c, g, or t
  misc_feature (1166)..(1166): n is a, c, g, or t
  misc_feature (1170)..(1170): n is a, c, g, or t
  misc_feature (1174)..(1174): n is a, c, g, or t
antagagaaattactatgagaggatcgcatcaccatcaccatcacggatcctatttaggtgacactatagaatcgtcgacccacgcgtccggcaacatcacggagtcataccctgctgtgccccccatctggtcggtggagtctgatgaccctaacttggctgctgtcttggagaggctggtggacataaagaaagggaatactctgctattgcagcatctgaagaggatcatctccgacctgtgtaaactctataacctccctcagcatccagatgtggagatgctggatcaacccttgccagcagagcagtgcacacaggaagacgtgtcttcagaagatgaagatgaggagatgcctgaggacacagaagacttagatcactatgaaatgaaagaggaagagccagctgagggcaagaaatctgaagatgatggcattggaaaagaaaacttggccatcctagagaaaattaaaaagaaccagaggcaagattacttaaatggtgcagtgtctggctcggtgcaggccactgaccggctgatgaaggagctcagggatatataccgatcacagagtttcaaaggcggaaactatgcagtcgaactcgtgaatgacagtctgtatgattggaatgtcaaactcctcaaagttgaccaggacagcgctttgcacaacgatctccagatcctcaaagagaaagaaggagccgacttcattctacttaacttttcctttaaagataactttccctttgacccaccatttgtcagggttgtgtctccagtcctctctggagggtatgttctgggcggaggggccatctgcatggaacttctcaccaaacagggctggagcagtgcctactccatagagtcagtgatcatgcanatcagtgccncactggtgaaggggaaagcncgagtgcagtttggancccacaaatctcaatacagtctgacaagancccnacaatcctacaagtccttggtgcaaatccncgaaaaaaacggctggnacnccccccaaaaaaaanggctancctggaanntcncccttcctccctccccaggnnccctnggaccaattaccnttgaagncggaatttggattcccccccnccccnggggttcccccccncntttttccggganggaaaacctccncctntgcnggaaa

SEQ ID NO: 101 - DNA, 1365 bp, Human
  misc_feature (13)..(13): n is a, c, g, or t
tttcccgtgcccnctcctagaaattctagagaggatcgcatcaccatcaccatcacggtcgacccacgcgtccgtgtgtttacagtacatggactggacctgcctggagcccagcccagagcatctcctcagtgctcatctctatccagtccctgatgactgagaacccctatcacaatgagcccggctttgaacaggagagacatccaggagacagcaaaaactataatgaatgtatccggcacgagaccatcagagttgcagtctgtgacatgatggaaggaaagtgtccctgtcctgaacccctacgaggggtgatggagaagtcctttctggagtattacgacttctatgaggtggcctgcaaagatcgcctgcaccttcaaggccaaactatgcaggacccttttggagagaagcggggccactttgactaccagtccctcttgatgcgcctgggactgatacgtcagaaagtgctggagaggctccataatgagaatgcagaaatggactctgatagcagttcatctgggacagagacagaccttcatgggagcctgagggtttagaccctgctcccatctccccttcccccactcaagagtcccagcagaatcccttccccccaccccagggatggagaggcactgtgtatctccctccagactcgaagtcatcctgcaagatggcaagaaccaagcaagctccgatcccagggtgtggggagtggggggcctgttcccggtctgacctccttggcactggagcatctggggcttcggtcatccattcatcccgtatcaggggccaaggtacctttacaggagcacctaaagcgagggcctttgtgacaaaacaaaacaaacaacaccccttctcaaaatggccagtccttaaggcataaaagaaacaatacaaattgccattccccaacgaacccctccccacagtctcatcgcaatcacctcccaacccaccctcctaaccaccccacactccaccccttaccacccactcgcccatcccctcaccacctcaccgaccccctaaccacgtctctcaacacctcttttctttcccacaccccctcccacccacacacacctcacacctcacccaataccatctaacccccacgcttctaacccactcaccacttacaactaactcttctcatctagtcaatcaccaacctccttccctactacctcccacactattctatccccacaagtctcctacccatctaccccaccatcaaactatcgcacttcagcaacccatgcacaccgcaccactcccgactccatcacactgcatcctcaccaccacactcccacttctcttgtccaacccactcct

SEQ ID NO: 102 - DNA, 1211 bp, Human
  misc_feature (2)..(2): n is a, c, g, or t
  misc_feature (865)..(865): n is a, c, g, or t
  misc_feature (870)..(870): n is a, c, g, or t
  misc_feature (916)..(916): n is a, c, g, or t
  misc_feature (932)..(932): n is a, c, g, or t
  misc_feature (965)..(965): n is a, c, g, or t
  misc_feature (973)..(973): n is a, c, g, or t
  misc_feature (988)..(988): n is a, c, g, or t
  misc_feature (990)..(991): n is a, c, g, or t
  misc_feature (993)..(993): n is a, c, g, or t
  misc_feature (997)..(997): n is a, c, g, or t
  misc_feature (1006)..(1006): n is a, c, g, or t
  misc_feature (1020)..(1020): n is a, c, g, or t
  misc_feature (1026)..(1026): n is a, c, g, or t
  misc_feature (1036)..(1036): n is a, c, g, or t
  misc_feature (1038)..(1038): n is a, c, g, or t
  misc_feature (1042)..(1042): n is a, c, g, or t
  misc_feature (1063)..(1063): n is a, c, g, or t
  misc_feature (1076)..(1077): n is a, c, g, or t
  misc_feature (1080)..(1080): n is a, c, g, or t
  misc_feature (1087)..(1087): n is a, c, g, or t
  misc_feature (1091)..(1091): n is a, c, g, or t
  misc_feature (1098)..(1098): n is a, c, g, or t
  misc_feature (1103)..(1103): n is a, c, g, or t
  misc_feature (1109)..(1109): n is a, c, g, or t
  misc_feature (1113)..(1113): n is a, c, g, or t
  misc_feature (1130)..(1130): n is a, c, g, or t
  misc_feature (1132)..(1132): n is a, c, g, or t
  misc_feature (1143)..(1143): n is a, c, g, or t
  misc_feature (1146)..(1146): n is a, c, g, or t
  misc_feature (1151)..(1151): n is a, c, g, or t
  misc_feature (1154)..(1154): n is a, c, g, or t
  misc_feature (1157)..(1157): n is a, c, g, or t
  misc_feature (1167)..(1167): n is a, c, g, or t
  misc_feature (1180)..(1180): n is a, c, g, or t
  misc_feature (1183)..(1183): n is a, c, g, or t
  misc_feature (1187)..(1187): n is a, c, g, or t
  misc_feature (1195)..(1195): n is a, c, g, or t
  misc_feature (1197)..(1198): n is a, c, g, or t
  misc_feature (1207)..(1207): n is a, c, g, or t
antagagagattactatgagaggatcgcatcaccatcaccatcacggatcctatttaggtgacactatagaatcgtcgacccacgcgtccgcccacgcgtccgagcctgcaaaaccacagcctaaaatgaaaacaaagagcgggcctgtcatggggggtgggctgccccctccacccataaagcataacatggacattggcacctgggataacaaggggcctgtgccgaaggccccagtcccccagcaggcaccctctccacaggctgccccacagccccagcaggtggctcagcctctcccagcacagcccccagctttggctcaaccgcagtatcagagccctcagcagccaccccagacccgctgggttgccccacgcaacagaaacgcggcgtttgggcagagcggaggggctggcagcgatagcaactctcctggaaacgtccagcctaattctgcccccagcgtcgaatcccaccccgtccttgaaaaactgaaggctgctcacagctacaacccgaaagagtttgagtggaatctgaaaagcgggcgtgtgttcatcatcaagagctactctgaggacgacatccaccgctccattaagtactccatctggtgtagcacagagcacggcaacaagcgcctggacagcgccttccgctgcatgagcagcaaggggcccgtctacctgctcttcagcgtcaatgggagtgggcatttttgtggggtggccgagatgaagtcccccgtggactacggcaccagtgccggggtctggtctcaggacaagtggaaggggaagtttgatgtccagtggatttttgttaaggatgtacccaataaccagctccggcacatcaggntgganaataacgacaacaaaccggtcacaaactcccgggacacccaggagntgccctttaaaaaaanccaaccaagtgctgaaaaattatcagttcttanaagcacanaacctccatctttcnannantttngctcattanaaaaaaacccccanaagaanaagaagttgntncccnaagaacggcaaaatccaaaanaaaaaatgaaggnnaancaatttnttanatgttcnaaagntttgantttnaaaaaagtttaaaaaancntgtgcttggtncancttcnatnggnccccccgggnggggttaaggttnaantttnctttttgncnnttaattttnccca

SEQ ID NO: 103 - DNA, 1304 bp, Human
  misc_feature (568)..(568): n is a, c, g, or t
  misc_feature (1170)..(1170): n is a, c, g, or t
  misc_feature (1199)..(1199): n is a, c, g, or t
  misc_feature (1265)..(1265): n is a, c, g, or t
  misc_feature (1287)..(1287): n is a, c, g, or t
  misc_feature (1299)..(1299): n is a, c, g, or t
cccccctaagagatactatagaggatcgcatcaccatcaccatcacggtcgacccacgcgtccgcccacgcgtccgggggaaggtggttctgaagacggatctgaggatgggcttcccgaaggaatccatctggataaaaatgatgatggaggaaaaataaaacatcttacatcttcaagagagtgtagttattgtggaaagtttttccgttcaaattattacctcaatattcatctcagaacgcatacaggtgaaaaaccatacaaatgtgaattttgtgaatatgctgcagcccagaagacatctctgaggtatcacttggagagacatcacaaggaaaaacaaaccgatgttgctgctgaagtcaagaacgatggtaaaaatcaggacactgaagatgcactattaaccgctgacagtgcgcaaaccaaaaatttgaaaagattttttgatggtgccaaagatgttacaggcagtccacctgcaaagcagcttaaggagatgccttctgtttttcagaatgttctgggcagcgctgtcctctcaccagcacacaaagatactcangatttccataaaaatgcagctgatgacagtgctgataaagtgaataaaaaccctacccctgcttacctggacctgttaaaaaagagatcagcagttgaaactcaggcaaataaactcatctgaagaacaaaggcgatgttactcctctccggatggcagtaccacccataaccttgaagttagcccccaagaaaaacaaacggaaaccggcgctgaatgcaaaaacggcccaagggggattgtcccgaaaaacctttaaattttcccgggggggtctttcaatttgcccgaaatttttttgaaaaaaaatttgtttccagaaacccgggcccttttgtacttcaagaatttttccccaaatttttttggggccccaaaaggggagcaaaaaaaccccgcggagcctaaaaaagtggaaaaaaccttttttaaaaaaccaaacccgggtcccccccattggtgggaaaaaatgtcccccccccctaattttaaaaccaaccccaatttttttccccacaccaaaaaccctcactcctaaagaagaaaaaaccctcttgccatacacccccccccttttcttaaaacacttttttttccccaanatccatttacctacaaaaaaaaatgagtncttggttcccacccccacacaaccataatattcaataacactccttcccacctaacaaaaaaaccnataccattctattaatcactcntcccacccactnaccaa

SEQ ID NO: 104 - DNA, 2668 bp, Human
atggaagttgaaggtgttggtgaagatgaagatcatcgtggtcgtcgtctgagcgatttttatgacattcatcaggaaattggtcgcggagcatttagctatctgcgtcgtattgttgaacgtagcagcggtctggaatttgcagcaaaatttattccgagccaggcaaaaccgaaagcaagcgcacgtcgtgaagcacgtctgctggcacgtctgcagcatgattgcgtgctgtattttcatgaagcatttgaacgtcgtcgtggtctggttattgttaccgaactgtgtaccgaagaactgctggaacgtattgcacgtaaaccgaccgtttgtgaaagcgaaattcgtgcatatatgcgtcaggttctggaaggtattcattatctgcatcagagccatgttctgcatctggatgttaaaccggaaaatctgctggtttgggatggtgcagccggtgaacagcaggttcgtatttgtgattttggtaatgcacaggaactgacccctggcgaaccgcagtattgtcagtatggtacaccggaatttgttgcaccggaaattgttaatcagtctccggttagcggtgttaccgatatttggcctgttggtgttgttgcatttctgtgtctgaccggtattagcccgtttgttggtgaaaatgatcgtaccaccctgatgaatattcgcaactataacgtggcatttgaagaaaccacctttctgagcctgagccgtgaagcccgtggttttctgattaaagttctggttcaggatcgtctgcgtccgaccgcagaagaaaccctggaacatccgtggtttaaaacccaggcaaaaggtgcagaagttagcaccgatcatctgaaactgtttctgagccgtcgtcgttggcagcgtagccagattagctataaatgtcatctggttctgcgtccgattccggaactgctgcgtgcaccgcctgaacgtgtttgggttaccatgcctcgtcgtccgcctccgagcggtggtctgagcagctctagcgatagcgaagaagaggaactggaagaactgccgagcgttccgcgtccgctgcagccggaatttagcggtagccgtgttagcctgaccgatattccgaccgaagatgaagcactgggtactccggaaaccggtgcagcaaccccgatggattggcaggaacagggtcgcgcaccgagccaggatcaggaagcaccgtcaccggaagcactgccgtcaccgggtcaggaaccggcagcaggcgcatctccgcgtcgtggtgaactgcgtcgtggtagcagcgcagaaagcgcactgcctcgtgcaggtccgcgtgaactgggtcgcggactgcataaagcagcaagcgttgaactgccgcagcgtcgttctccgagtccgggtgcaacccgtctggcacgtggtggtctgggtgaaggtgaatatgcacagcgtctgcaggcactgcgtcagcgtctgctgcgtggtggtccggaagatggtaaagttagcggtctgcgtggtccgctgctggaaagcctgggtggtcgtgcacgtgatccgcgtatggcacgtgcagcaagcagcgaagcagcaccgcatcatcagcctccgctggaaaatcgtggtctgcagaaaagcagcagctttagccagggtgaagcagaaccgcgtggtcgtcatcgtcgtgccggtgctcctctggaaattcctgttgcacgtctgggtgcacgtcgtctgcaagaaagcccgagcctgagcgcactgagcgaagctcagccgtctagtccggcacgtccgagcgcaccgaaaccgagcaccccgaaaagcgcagaaccgagcgcaaccaccccgtctgatgcacctcagcctccggcaccgcagcctgcacaggataaagcaccggaaccgcgtccggaaccggttcgtgcaagcaaaccggcaccgcctccgcaggcactgcagacactggcactgccgctgaccccgtatgcacagattattcagagcctgcagctgagcggtcatgcacagggtccgagccagggtcctgcagcaccgcctagcgaacctaaaccgcatgcagcagtttttgcacgtgttgcatctccgcctccgggtgcaccggaaaaacgtgttccgagcgcaggcggtccaccagttctggcagaaaaagcacgtgttccgaccgttccgcctcgtccgggtagcagcctgagcagctctattgaaaatctggaaagcgaagccgtttttgaagccaaatttaaacgtagccgtgaatctccgctgagcctgggtctgcgtctgctgagccgtagccgtagcgaagaacgtggtccgtttcgtggtgccgaagaggaagatggtatttatcgtccgtcaccggcaggtacaccgctggaactggttcgtcgtccggaacgtagccgttcagttcaggatctgcgtgcagttggtgaaccgggtctggttcgtcgcctgagcctgtctctgagccagcgtctgcgtcgtacaccgcctgcacagcgtcatccggcatgggaagcgcgtggtggtgatggtgaaagcagcgaaggtggtagctctgcacgtggttctccggttctggcaatgcgtcgtcgtctgtcttttaccctggaacgctaagcggccgcttaattaa

SEQ ID NO: 105 - DNA, 867 bp, Human
  misc_feature (769)..(769): n is a, c, g, or t
  misc_feature (775)..(775): n is a, c, g, or t
  misc_feature (778)..(778): n is a, c, g, or t
  misc_feature (782)..(782): n is a, c, g, or t
  misc_feature (808)..(809): n is a, c, g, or t
  misc_feature (864)..(865): n is a, c, g, or t
gatactatgagaggtcgcatcccatcccatcacggatcctatttaggtgacactatagaatcgtcgactctggaccttggctgtcactcagttgaagggcggagctggggtgagggtccaaggggcccaggacttggccggcgtgatctcagctctgcagaccctgcggtgctgggagccaccatggagagtaggtgctacggctgcgctgtcaagttcaccctcttcaagaaggagtacggctgtaagaattgtggcagggccttctgttcaggctgcctaagcttcagtgcagtagtgcctcggactgggaacacccaacagaaagtctgcaagcaatgccatgaggtcctgaccagagggtcttctgccaatgcctccaagtggtcaccacctcagaactataagaagcgtgtggcagccttggaagccaagcaaaagcccagcacttcccagagccagggactgacacgacaagaccagatgattgctgagcgcctagcacgactccgccaggagaacaagcccaagttagtcccctcacaggcagagatagaggcacggctggctgtcctaaaggatgaacgtcagggttccatcccttccacccaggaaatggaggcacgacttgcagcgttgcagggcagagttctaccttctcaaaccccccagccggcacatcacacaccggacaccaggaccccagcccagcagacacaggatctgctaacgcagctggcagctgaagtggctatcgatgaaagctggnaaggangangccnagctgcctctctccagatgatctcanncaggtggcccaggagcacaattccaagagcaggccactggtcttttgagagagannac

SEQ ID NO: 106 - DNA, 1261 bp, Human
  misc_feature (842)..(842): n is a, c, g, or t
  misc_feature (873)..(873): n is a, c, g, or t
  misc_feature (904)..(904): n is a, c, g, or t
  misc_feature (922)..(922): n is a, c, g, or t
  misc_feature (942)..(942): n is a, c, g, or t
  misc_feature (944)..(944): n is a, c, g, or t
  misc_feature (947)..(947): n is a, c, g, or t
  misc_feature (951)..(951): n is a, c, g, or t
  misc_feature (962)..(962): n is a, c, g, or t
  misc_feature (967)..(967): n is a, c, g, or t
  misc_feature (977)..(977): n is a, c, g, or t
  misc_feature (995)..(995): n is a, c, g, or t
  misc_feature (1003)..(1003): n is a, c, g, or t
  misc_feature (1008)..(1008): n is a, c, g, or t
  misc_feature (1020)..(1020): n is a, c, g, or t
  misc_feature (1041)..(1041): n is a, c, g, or t
  misc_feature (1079)..(1079): n is a, c, g, or t
  misc_feature (1083)..(1083): n is a, c, g, or t
  misc_feature (1088)..(1088): n is a, c, g, or t
  misc_feature (1092)..(1093): n is a, c, g, or t
  misc_feature (1101)..(1101): n is a, c, g, or t
  misc_feature (1105)..(1105): n is a, c, g, or t
  misc_feature (1108)..(1109): n is a, c, g, or t
  misc_feature (1118)..(1118): n is a, c, g, or t
  misc_feature (1151)..(1151): n is a, c, g, or t
  misc_feature (1166)..(1166): n is a, c, g, or t
  misc_feature (1176)..(1176): n is a, c, g, or t
  misc_feature (1198)..(1198): n is a, c, g, or t
  misc_feature (1216)..(1216): n is a, c, g, or t
  misc_feature (1219)..(1219): n is a, c, g, or t
  misc_feature (1224)..(1225): n is a, c, g, or t
  misc_feature (1229)..(1229): n is a, c, g, or t
  misc_feature (1232)..(1232): n is a, c, g, or t
  misc_feature (1236)..(1236): n is a, c, g, or t
  misc_feature (1240)..(1240): n is a, c, g, or t
  misc_feature (1249)..(1249): n is a, c, g, or t
  misc_feature (1251)..(1251): n is a, c, g, or t
  misc_feature (1254)..(1254): n is a, c, g, or t
ctattagagaaattactatgagaggatcgcatcaccatcaccatcacggatcctatttaggtgacactatagaatcgtcgacccacgcgtccggcgaggcggaccctgaagcggaccccgaggaagccactgctgccagggtgattgacaggtttgatgaaggggaagatggggaaggtgatttcctagtagtgggtagcattagaaaactggcatcagcctccctcttggacacggacaaaaggtattgcggcaaaaccacctctagaaaagcatggaatgaagaccattgggagcagactctgccaggatcgtctgatgaggaaatatctgatgaggaagggtctggagatgaagattcagagggactgggtctggaggaatatgatgaggacgacctgggtgctgctgaggaacaggagtgtggtgatcacagggagagcaagaagagcagaagccactctgcaaaaacaccgggcttcagtgtccagagtatcagtgactttgagaaatttaccaagggaatggatgaccttgggagcagtgaggaggaggaagacgaagagagtggcatggaagaaggggatgacgcggaagactcccaaggcgagagtgaggaagacagggctggagatagaaacagtgaggatgatggtgtggtgatgaccttctctagtgtcaaagtttctgaggaagtggagaaaggaagagccgtgaagaaccagatagcactgtgggaccagctcttggaaggaaggatcaaactacaaaaagctctgttgaccaccaaccagcttcctcaaccagatgttttcccattgttcaaggacaaaggtggcccnaaaattttccagtgcccctgaaaaatagtcncaaggcactttaaagcattgttgaggtcatnggtaggtcttccaggaanagttgcttttccagtacccnanacnctanatatctagtanatggnacaaagcccnatgcgggaagtggagganatttctantgaanatgatgacctgntaaaaaaaaaaaacccccacnaaaaaaggtccctgccaaaaagaaactggaaatggagnactntcccncctnntgggcaancccnttnncccattttnagtctacggaaccccccccttcaaaattggccnaaaaaacccaactgntttctgaaanctgggaaagggttttggggccntttaacccaaaacttggnccnaatcnnccanttntgangganaaaaaaatntnttnaaagaaa

SEQ ID NO: 107 - DNA, 907 bp, Human
  misc_feature (765)..(765): n is a, c, g, or t
  misc_feature (801)..(801): n is a, c, g, or t
  misc_feature (803)..(805): n is a, c, g, or t
  misc_feature (835)..(835): n is a, c, g, or t
  misc_feature (865)..(865): n is a, c, g, or t
  misc_feature (871)..(872): n is a, c, g, or t
aatactatgagaggtcgcatcaccatcaccatcacggatcctatttaggtgacactatagaatcgtcgactctggaccttggctgtcactcagttaagattattgctccagccaaccttgaacgaccagttcgttatattagaaaacctattgactatacaattctagatgatattggacatggagtaaaggtgagtacccagaacatgaagatgggtgggctgccgcgtacaacacctccaactcagaagccccctagtccccctatgtcagggaaagggacacttgggcggcactccccctatcgcacactggagccagtgcgtcctccagtggtaccaaatgattacgtacctagcccaacccgtaatatggctccctcgcagcagagccctgtgaggacagcttctgtgaatcaaagaaatcgaacttacagcagcagtgggagtagtggagggagccacccaagtagtcggagcagcagtcgagagaacagtggaagtggtagtgtgggggttcctattgctgttcctactccatctcctcccagtgtctttccaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtttcagatacaccacctcaccgccacctgtggaagaacagtcttngatgagtctcccccactcctctcctcagaagatacnannnagagagctgctgtggtgaatatatgatccntatgctgagagacccacgtggctcacgtcntactgnnaagtgtgcattatgataacaagacaggagagactg

SEQ ID NO: 108 - DNA, 1218 bp, Human
  misc_feature (4)..(5): n is a, c, g, or t
  misc_feature (8)..(8): n is a, c, g, or t
  misc_feature (16)..(16): n is a, c, g, or t
  misc_feature (18)..(18): n is a, c, g, or t
  misc_feature (20)..(20): n is a, c, g, or t
  misc_feature (38)..(38): n is a, c, g, or t
  misc_feature (48)..(48): n is a, c, g, or t
  misc_feature (63)..(63): n is a, c, g, or t
  misc_feature (107)..(107): n is a, c, g, or t
  misc_feature (910)..(910): n is a, c, g, or t
  misc_feature (960)..(960): n is a, c, g, or t
  misc_feature (964)..(964): n is a, c, g, or t
  misc_feature (976)..(976): n is a, c, g, or t
  misc_feature (1001)..(1001): n is a, c, g, or t
  misc_feature (1006)..(1007): n is a, c, g, or t
  misc_feature (1009)..(1010): n is a, c, g, or t
  misc_feature (1019)..(1019): n is a, c, g, or t
  misc_feature (1041)..(1041): n is a, c, g, or t
  misc_feature (1047)..(1047): n is a, c, g, or t
  misc_feature (1049)..(1049): n is a, c, g, or t
  misc_feature (1054)..(1054): n is a, c, g, or t
  misc_feature (1064)..(1064): n is a, c, g, or t
  misc_feature (1068)..(1068): n is a, c, g, or t
  misc_feature (1074)..(1074): n is a, c, g, or t
  misc_feature (1087)..(1088): n is a, c, g, or t
  misc_feature (1094)..(1094): n is a, c, g, or t
  misc_feature (1101)..(1101): n is a, c, g, or t
  misc_feature (1116)..(1116): n is a, c, g, or t
  misc_feature (1120)..(1120): n is a, c, g, or t
  misc_feature (1128)..(1128): n is a, c, g, or t
  misc_feature (1131)..(1131): n is a, c, g, or t
  misc_feature (1133)..(1133): n is a, c, g, or t
  misc_feature (1138)..(1139): n is a, c, g, or t
  misc_feature (1154)..(1154): n is a, c, g, or t
  misc_feature (1180)..(1180): n is a, c, g, or t
  misc_feature (1182)..(1182): n is a, c, g, or t
  misc_feature (1191)..(1192): n is a, c, g, or t
  misc_feature (1195)..(1195): n is a, c, g, or t
  misc_feature (1208)..(1208): n is a, c, g, or t
  misc_feature (1213)..(1213): n is a, c, g, or t
catnnagnaattactntnanaggatcgcatcaccatcnccatcacggntcctatttaggtganactatagaatcgtcgacccacgcgtccgcccacgcgtccgcgcngcgactgagcttgggtccgactggagctcaggctcgcgacccagactggtgggccaggcctccaagccggccttacacccaatccaaggaggacagaccggacacagagggacggagcgagcaaggagacatggcttcatcattcctgcccgcgggggccatcaccggcgacagcggtggagagctgagctcaggggacgactccggggaggtggagttcccccatagccctgagatcgaggagaccagttgcctggccgagctgtttgagaaggctgccgcgcacctgcaaggcctgattcaggtggccagcagggagcagctcttgtacctgtatgccaggtacaaacaggtcaaagttggaaattgtaatactcctaaaccaagcttctttgattttgaaggaaagcaaaaatgggaagcttggaaagcacttggtgattcaagccccagccaagcaatgcaggaatatatcgcagtagttaaaaaactagatccaggttggaatcctcagataccagagaagaaaggaaaagaagcaaatacaggttttggtgggccagttattagttctctatatcatgaagaaaccatcagggaagaagacaaaaatatatttgattactgcagggaaaacaacattgaccatataaccaaagccatcaaatcgaaaaatgtggatgtgaatgtgaaagatgaagagggtagggctctacttcactgggcctgtgatcgaggacataaggaactagtcacagtgttgctgcaacatagagctgaaattaactgtcaggacaatgaangccaaacagctctacattatgcctctgcctgtgaattttctggatattgnaaanctgctgctccantctggtgctgaccccactctccaanaccannanngcttgcctnccaaaagaaggtgacaggcttncaaaananttttntttggtgctncacngccccncaattggcaaggnnttaatnaaaaaanttggaaacttgccancttntaaaaccnaangncttcnnttttaaaaaaaactnaaaaaaaaaaacttttttttcccccntnctttgaaannatngccaaaaaaaccnttttnggaac

SEQ ID NO: 109 - DNA, 1186 bp, Human
  misc_feature (1)..(4): n is a, c, g, or t
  misc_feature (842)..(842): n is a, c, g, or t
  misc_feature (849)..(849): n is a, c, g, or t
  misc_feature (888)..(888): n is a, c, g, or t
  misc_feature (891)..(891): n is a, c, g, or t
  misc_feature (895)..(895): n is a, c, g, or t
  misc_feature (903)..(903): n is a, c, g, or t
  misc_feature (929)..(929): n is a, c, g, or t
  misc_feature (932)..(932): n is a, c, g, or t
  misc_feature (947)..(947): n is a, c, g, or t
  misc_feature (962)..(962): n is a, c, g, or t
  misc_feature (968)..(968): n is a, c, g, or t
  misc_feature (971)..(971): n is a, c, g, or t
  misc_feature (978)..(978): n is a, c, g, or t
  misc_feature (982)..(982): n is a, c, g, or t
  misc_feature (1004)..(1004): n is a, c, g, or t
  misc_feature (1016)..(1016): n is a, c, g, or t
  misc_feature (1021)..(1021): n is a, c, g, or t
  misc_feature (1026)..(1026): n is a, c, g, or t
  misc_feature (1049)..(1049): n is a, c, g, or t
  misc_feature (1064)..(1065): n is a, c, g, or t
  misc_feature (1069)..(1069): n is a, c, g, or t
  misc_feature (1072)..(1073): n is a, c, g, or t
  misc_feature (1075)..(1075): n is a, c, g, or t
  misc_feature (1077)..(1077): n is a, c, g, or t
  misc_feature (1110)..(1110): n is a, c, g, or t
  misc_feature (1114)..(1114): n is a, c, g, or t
  misc_feature (1125)..(1125): n is a, c, g, or t
  misc_feature (1131)..(1131): n is a, c, g, or t
  misc_feature (1142)..(1142): n is a, c, g, or t
  misc_feature (1155)..(1155): n is a, c, g, or t
  misc_feature (1164)..(1164): n is a, c, g, or t
  misc_feature (1179)..(1179): n is a, c, g, or t
  misc_feature (1181)..(1186): n is a, c, g, or t
nnnntagagaaattactatgagaggatcgcatcaccatcaccatcacggatcctatttaggtgacactatagaatcgtcgacccacgcgtccgggggaaggaggatggcggatatcatcgcaagactccgggaggacgggatccaaaaacgtgtgatacaggaaggccgaggagagctcccggactttcaagatgggaccaaggccacgttccactaccggacgctgcacagtgacgacgagggcaccgtgctggacgacagccgggctcgtggcaagcccatggagctcatcattggcaagaagttcaagctgcctgtgtgggagaccatcgtgtgcaccatgcgagaaggggagattgcccagttcctctgtgacatcaagcatgtggtcctgtacccgctggtggccaagagtctccgcaacatcgcggtgggcaaggaccccctggagggccagcggcactgctgcggtgttgcacagatgcgtgaacacagctccctgggccatgctgacctggacgccctgcagcagaacccccagcccctcatcttccacatggagatgctgaaggtggagagccctggcacgtaccagcaggacccatgggccatgacagacgaagagaaggcaaaggcagtgccacttatccaccaggagggcaaccggttgtaccgcgaggggcatgtgaaggaggctgctgccaagtactacgatgccattgcctgcctcaagaacctgcagatgaaggaacagcctgggtcccctgaatggatccagctggacaagcagatcacgccgctgctgctcaactactgccagtgcaagctggtggtcgaggantactacnaagtgctggaccactgctcttccatcctcaacaagtacnacnacancgtcaagnctacttcaagcggggcaaggcccacncgnccgtgtggaatgccnagaagcccagctgantttgcnaantgctganctgnaccaccctggccctgtggtgancaaaactgcggncctgnaggcncgatccgcaaaagacaaaaaaanaaacccgttccgggnntttnccnntnanagaaaattgcctgcttactgcaaaccatttganttcnaccccctgccnggttgnttttgtttttnttttaagcctttntttttttcnaaaaaaaaaaaaaanannnnnn

SEQ ID NO: 110 - DNA, 1170 bp, Human
  misc_feature (899)..(899): n is a, c, g, or t
  misc_feature (919)..(919): n is a, c, g, or t
  misc_feature (923)..(923): n is a, c, g, or t
  misc_feature (925)..(925): n is a, c, g, or t
  misc_feature (928)..(928): n is a, c, g, or t
  misc_feature (945)..(945): n is a, c, g, or t
  misc_feature (949)..(949): n is a, c, g, or t
  misc_feature (961)..(962): n is a, c, g, or t
  misc_feature (966)..(966): n is a, c, g, or t
  misc_feature (984)..(985): n is a, c, g, or t
  misc_feature (991)..(991): n is a, c, g, or t
  misc_feature (1004)..(1004): n is a, c, g, or t
  misc_feature (1032)..(1032): n is a, c, g, or t
  misc_feature (1039)..(1039): n is a, c, g, or t
  misc_feature (1041)..(1041): n is a, c, g, or t
  misc_feature (1047)..(1047): n is a, c, g, or t
  misc_feature (1059)..(1059): n is a, c, g, or t
  misc_feature (1080)..(1080): n is a, c, g, or t
  misc_feature (1085)..(1085): n is a, c, g, or t
  misc_feature (1087)..(1087): n is a, c, g, or t
  misc_feature (1090)..(1090): n is a, c, g, or t
  misc_feature (1096)..(1096): n is a, c, g, or t
  misc_feature (1098)..(1098): n is a, c, g, or t
  misc_feature (1108)..(1108): n is a, c, g, or t
  misc_feature (1112)..(1112): n is a, c, g, or t
  misc_feature (1117)..(1117): n is a, c, g, or t
  misc_feature (1122)..(1122): n is a, c, g, or t
  misc_feature (1128)..(1128): n is a, c, g, or t
  misc_feature (1130)..(1130): n is a, c, g, or t
  misc_feature (1132)..(1132): n is a, c, g, or t
  misc_feature (1144)..(1144): n is a, c, g, or t
  misc_feature (1152)..(1152): n is a, c, g, or t
  misc_feature (1157)..(1159): n is a, c, g, or t
  misc_feature (1164)..(1164): n is a, c, g, or t
tagagaaattactatgagaggatcgcatcaccatcaccatcacggatcctatttaggtgacactatagaatcgtcgacccacgcgtccggcattgaccgtggcgagatcgtgaacatgctggagggttccggccgacagagccgcaacttgaagccagacaggcggcacaccgaccgtgactactcgctgtcaccctcccagatgaatggttactcctcactgcaggacgagctgctgtcccctgcctccctgggctgtgcactttcctctccgctacgtgcagaccagtactggaatgaggtggccgtcctagacgccatccccttggcggccacggagcatgacaccatgctggagatgtctgacatgcaggtgtggtctgcgggcctcacgccttctctggtcactgctgaggactcctctctggagtgtagcaaggctgaggactctgatgccacaggtcacgagtggaagttggagggggcactctcagaggaaccgcggggccccgagttgggctctctggaacttgtggaggacgacacagtggattcagatgccacaaatggccttatcgatttgcttgaacaggaggaaggtcagaggtcagaagagaagctgccaggttctaagaggcaggatgatgcgacaggtgcagggcaggactcagagaatgaagtgtctcttgtttcaggccatcagagggggcaagcccgaatcacacattcccccaccgtgagtcaggtgacggagaggagtcaggacagactgcaggactgggatgcagacggctcgattgtctcatacctgcaagatgctgcacaaggttcctggcaagaagaggtcacgcaaggtccacactcattccagggaacaagtaccatgactgaagggctanagcccggtggatctcaggantacnanaangtcctggtgtctgtaantgancacacgtggacnnaaancccgaggctgaaactccnngccganaggaccgaagcancaaggccaaaaaaacagggcaggaggcnaaaaacntnccccantggggagggaangaatttcaaaattccagggancaggnanaanaaacantnccggataaangggnaattntcccnaaaaantntnccaaggggtttnaaaaaaantttcnnncccantccccc

SEQ ID NO: 111 - DNA, 1394 bp, Human
  misc_feature (1)..(2): n is a, c, g, or t
  misc_feature (14)..(14): n is a, c, g, or t
  misc_feature (879)..(879): n is a, c, g, or t
nncccgcacccccncctaagaatactagagaggatgcatcaccatcaccatcacggtcgacccacgcgtccgcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtcccccccagcccctcccctccccataccaaagtgctgacaggccctccgtgcccctcccaccctggtccgcctccctggcctggctcaaccgagtgcctccgacccccctcctcagcccctcccccaccacaggcccagcctcctcggnctccggtctcgttgctgcttctggctgggctgggggggacgaagcccctgcccggccctctgccgccccttttgtggcccccgggttttttctccccgcccccccgaggcttgcttccggagggaaccgaagaccatttatcatgcccccggaatcccccgaacacttaccccattgctcccaaacgaaccctttggggaaaacccccaccctgaggtgccacacttcccttcccccttgctgccgtgttacccccactaatctactaacccgagtacactaaaaaaaacttttgacatctttctagcagacacctcttatcatacccctaatccaacaatccacatccccccactacttccttagatacaactaccctatcacgccctactatcacttccatctctccataccatactcacgcaccctccccgcgctccctacccatcaactcccccatcacctttcatcaaactctccacgaatactaccgaccaccccacactgactctctc

SEQ ID NO: 112 - DNA, 818 bp, Human
  misc_feature (2)..(2): n is a, c, g, or t
  misc_feature (4)..(4): n is a, c, g, or t
tnanaggagaattaactatgagaggatcgcatcaccatcaccatcacggatcctatttaggtgacactatagaatcgtcgacccacgcgtccggaacaaaccttggaaatgttattgataactatgtttatgaacataccctgacagggaaaaatgcattttttgtgggagatcttggaaagattgtgaagaaacacagtcaatggcagaatgtagtggctcagataaagccattctacacagtgaagtgcaactctgctccagctgtacttgagattttggcagctcttggaaccggatttgcttgttccagtaaaaatgaaatggctttagtgcaagagttgggtgtacctccagaaaacattatttacataagtccttgcaagcaagtgtctcagataaagtatgcagcaaaagttggagtgaatatcctgacatgtgacaatgaaattgaattgaagaaaattgcacgtaatcacccaaatgccaaggtcttactacatattgcaacagaagataatattggaggtgaagagggtaacatgaagtttggcactaccctgaagaactgtaggcatctcttggaatgtgctaaggaacttgatgtccaaataattggggttaaatttcatgtttcgagtgcttgcaaagaatctcaagtatatgtacatgctctatctgatgctcgatgtgtgtttgacatggctggagaaattggctttacgatgaacatgttagacattggtggaggattcacgggaactgaatttcaattggaagaggttaatcatgttatcagcccctctggtggatatcta

SEQ ID NO: 113 - DNA, 1165 bp, Human
  misc_feature (1)..(2): n is a, c, g, or t
  misc_feature (916)..(916): n is a, c, g, or t
  misc_feature (949)..(950): n is a, c, g, or t
  misc_feature (983)..(983): n is a, c, g, or t
  misc_feature (987)..(987): n is a, c, g, or t
  misc_feature (989)..(990): n is a, c, g, or t
  misc_feature (992)..(992): n is a, c, g, or t
  misc_feature (1014)..(1014): n is a, c, g, or t
  misc_feature (1027)..(1027): n is a, c, g, or t
  misc_feature (1040)..(1040): n is a, c, g, or t
  misc_feature (1043)..(1043): n is a, c, g, or t
  misc_feature (1048)..(1048): n is a, c, g, or t
  misc_feature (1050)..(1050): n is a, c, g, or t
  misc_feature (1054)..(1054): n is a, c, g, or t
  misc_feature (1058)..(1058): n is a, c, g, or t
  misc_feature (1060)..(1060): n is a, c, g, or t
  misc_feature (1087)..(1087): n is a, c, g, or t
  misc_feature (1101)..(1101): n is a, c, g, or t
  misc_feature (1107)..(1107): n is a, c, g, or t
  misc_feature (1129)..(1129): n is a, c, g, or t
  misc_feature (1131)..(1131): n is a, c, g, or t
  misc_feature (1139)..(1139): n is a, c, g, or t
  misc_feature (1146)..(1146): n is a, c, g, or t
nnattagagaaattactatgagaggatcgcatcaccatcaccatcacggatcctatttaggtgacactatagaatcgtcgacccacgcgtccgcggaagcgggggtgcagcgcggcagaatgagggttgattcctcggctgaccccacaatgtcgcaggagcaagggccggggtcctccacgcctcccagttctccgacacttcttgacgctctgctccagaacctttacgactttggaggtacagaaggtgaaacagaacagaagaagatcataaagaaaagggaaaacaagaagagagatgtgatggcttcagcggccttggcagcagagccatctcccctacctggttctctcataagaggccagaggaagagcgcttcgagcttcttcaaggaacttagagaagagcggcattgtgctccttctgggacccccacaggaccagagatccttgctgctgcagttcctccctcttccctaaagaacaatagggaacaagtagaagtggtagaatttcacagcaataaaaaaagaaaattgacgccagatcataacaagaacacaaaggctaatcctagtgttttggagagagatgtggatacacaagaatttaacctagaaaaagctcgtttagaagtgcaccggtttggtatcacgggttatggaaaaggaaaggagagaatcctggaacaggaacgtgccattatgctgggcgctaagcctcctaaaaagagttatgtgaattacaaggttttacaggagcaaattaaagaaaaaaaggcagcaaaggaagaagaaaagagactggcccaagaaaacagatattttcaagaaaagaagaggaaaggacaggaggacaggaaatccaaaaaagaagtccgctcccagtattttgtcaaatggacggattgganaggttggaaaaattcaaaaatggaacactgatnntgagccccagttgatatcaagaaaaataaattncttncnnanggggccaaatgaaagtactttngtcaaataaaacngaggatggggaanaanttgantncaantggnancgggcccttggaaccctgggggaactntaaaaaaaattcgntttttnaaacccccatttcccaaaactngntttttttnttttttnaaaaaaaaaaggtccaacc

SEQ ID NO: 114 - DNA, 788 bp, Human
  misc_feature (755)..(755): n is a, c, g, or t
  misc_feature (757)..(758): n is a, c, g, or t
  misc_feature (761)..(762): n is a, c, g, or t
  misc_feature (780)..(787): n is a, c, g, or t
ttactatgagaggtcgcatcaccatcaccatcacggatcctatttaggtgacactatagaatcgtcgactctggaccttggctgtcactcagttggtgttctatccgccgcctccaccttccatccggcgccggctttcggcgcgacggtcgccgcgttccatcgtcgcgcggcccttcgggcgcccgagcccgcaatgtcgggccccaacggagacctggggatgccggtggaggcgggagcggaaggcgaggaggacggcttcggggaagcagaatacgctgccatcaactccatgctggaccagatcaactcctgtctggaccacctggaggagaagaatgaccacctccacgcccgcctccaggagctgctggagtccaaccggcagacacgcctggagttccagcagcagctcggggaggcccccagtgatgccagcccctaggctccaagagcccccaaccgggacccaaccctgcctccctgggctaggctctggcctgggcactcaccccctggcttagacaccttctcaagggctggccttcagggacccctggtgggtctgcctgcctgggccacccttcctgcctgggcctccccttggcctacctgggccagcccccaccacctggcatgccctcctggggccaagagtgggcctgcaacccacccacttgcctgcccacccaactcctgagcgctccccactctgccccagccttgagtgtccacattaaatgggtctcccncnnggnnaaaaaaaaaaagagaaannnnnnnng

SEQ ID NO: 115 - DNA, 847 bp, Human
  misc_feature (766)..(766): n is a, c, g, or t
tagagaattactatgagaggtcgcatcaccatcaccatcacggatcctatttaggtgacactatagaatcgtcgactctggaccttggctgtcactcagttaaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctgctgacaaaccaagaggatttgccagaggtcttgatcctgaaagaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtangtgcttcctttatcagaaaagaacatttgataccatggtatatcatttcccctctcataagaacagcttttctaaatggtg

SEQ ID NO: 116 - DNA, 1669 bp, Human
atgtctcatggtccgtcaccgcgtctggcagaatctccgcagctgagcaaaggtagcctgctgaccattctgggtagcccgtcaccggaacgtatgggtccggcagatagcctgcctccgacccctccgtctggtacaccgtcaccgggtcctccgcctgcactgcctctgcctccggcaccagcactgctggcagatggtgattgggaaagccgtgaagaactgcgtctgcgtgaactggaagaagcacgcgcacgcgcagcacagatggaaaaaaccatgcgttggtggagcgattgtaccgcaaattggcgtgaaaaatggtctaaagtgcgtgcagaacgtaatcgtgcacgtgaagaagttcgtcagctgcgtcagcgtctggatgcactgaccaaagaactggcaggcgcacgtcgtgaacgtcaagaagcacagggtgaatgcgaagcacgtggtcgtgaactggcacgtctgcgtggtgcacgtggtgttgcagatcagacccgtgatggtccggaaccggaagcagaacgtgaaccggttcgtgatgttggtagcgaacgtccgcctggtagccaggaactggaactggttgaaagcctgctgaaaagcatgccggaagaaagcgaagattgttgggaagcacgtagcctgggtgccggtggtccgcgtggtagcagcggtcgtcaggaacgtagccgtctgccgtgggaagataccgcagcaaccgaagaagaagcaagcaaactgaccgcactgcgcctgcgcctggacgaaagccagaaagttctgctgaaagaacgtgaagataaactggcactgagccgcaatattgaaaaactggaaggtgaactgagccagtggaaaatcaaatacgaggaactgagcaaaaccaaacaggaaatgctgaaacagctgagcattctgaaagaagcacatcaggacgaactgggtcgtatgagcgaagatctggaagatgaactgggtgcacgtagcagcatggatcgtaaaatggcagaactgcgtggtgaaatggaacgtctgcaggcagaaaatgcagcagaatggggtcgtcgtgaacgcctggaaaccgaaaaactgggtctggaacgcgaaaataaaaaactgcgtgcacaggttggcgatctggaagaagccctggcacgtcgtcgtcgtcagaccgcaagcgcactggattgtgatctgcgtgcaagccaggcagcactgtttgaaaaaaacaaagagctggccgatctgaaacatgttcatggcaaactgaaaaaacagttccaggaaaaagttgcagaactggcacatgcaaatcgtcgtgttgaacagcatgaagccgaagtgaaaaaactgcgcctgcgcgttgaagaactgaaaaaagaactggcccaggcagaggatgaactggatgaagcccataatcaggcacgtaaactgcagcgtagcctggatgaacagaccgaacagagcgaaaatctgcaggttcaactggaacatctgcaaagccgtctgcgtcgtcagcagcagaatgcaccgctgtttggtaaaattcgtagcgcacgttttggcaccgaagaggcagaagatggcaccagcgacctggacgaagatgaagatctgcagattcaggttgcctaagcggccgcttaattaa

SEQ ID NO: 117 - DNA, 887 bp, Human
  misc_feature (806)..(806): n is a, c, g, or t
  misc_feature (809)..(810): n is a, c, g, or t
  misc_feature (873)..(873): n is a, c, g, or t
tactatgagaggtcgcatcaccatcccatcacggatcctatttaggtgacactatagaatcgtcgactctggaccttggctgtcactcagttattgcagtgtactatttgcttccaaaggatcaggggatcaccctgagaaagctggtacggggcgccaccctggacatcgtggatggcatggctcagctcatggaagtactttccgtcactccaactcagagccctgagaacaatgaccttatttcctacagcagtgtctgggttgcgtgccagcagatgcctcagataccaagagataacaaagctgcagctcttttgatgctgaccaagaatgtggattttgtgaaggatgcacatgaagaaatggagcaggctgtggaagaatgtgacccttactctggcctcttgaatgatactgaggagaacaactctgacaaccacaatcatgaggatgacgtgttggggtttcccagcaatcaggacttgtattggtcagaggacgatcaagagctcataatcccatgccttgcgctggtgagagcatccaaagcctgcctgaagaaaattcggatgttagtggcagagaatgggaagaaggatcaggtggcacagctggatgacattgtggatatttctgatgaaatcagccctagtgtggatgatttggctctgagcatatatccacctatgtgtcacctgaccgtgcgaatcaattctgcgaaacttgtatctgttttaaagaaggcactttgaatttacaaaagcagtcatgtgacccctcagccagagaatagtggatccttnacnntattatgcatgatctttgctgataagatcaggagctcatcgagtgaactgaatatgactttcngctcattgactccc

SEQ ID NO: 118 - DNA, 992 bp, Human
catcaccatcaccatcacggatcctatttaggtgacactatagaatcgtcgacccacgcgtccgtgagtggtagcctttcccctcaaccagcaatggaggagcagccccagatgcaagacgccgacgagcccgcggactccggaggggaaggccgggcaggcgggccaccgcaggtcgccggcgcccaggcggcgtgcagcgaggaccgcatgaccctgctcctcaggctgagagcacagacaaaacaacaactcttagaatataaatcaatggttgatgcaagtgaagaaaaaactccagaacaaattatgcaagaaaagcaaatcgaagctaaaattgaagacctggaaaatgaaattgaagaggtaaaagttgcttttgagataaaaaagcttgcattagacaggatgagactttcaactgcacttaaaaaaaacctggagaaaattagcagacagtctagtgtgctcatggataacatgaaacacctattagagctaaataaattaataatgaaatcacagcaggaatcttgggatttagaggaaaaactgcttgatattagaaagaagagattgcaattaaaacaagcttcagaaagtaagcttttagaaatacagactgaaaagaacaaacagaagattgatttggacagtatggaaactcagagaggataaagatcatacgacaaaacctacagatggagataaaaattactactgttattcaacatgtgttccagaaccttattttggggagtaaagtcaattgggcagaggatcctgcccttaaggaaattgttctgcagcttgagaagaatgttgacatgatgtaataagaattcttttctgacatattttacatttctggcaatctcaactcttatttggaatacttctgtgcatttgtctgtccaccgtaattttagaaaagcatatccataacgtttacagttgtagtacagttgtggttagttatttgtagtgggatt

SEQ ID NO: 119 - DNA, 846 bp, Human
  misc_feature (19)..(19): n is a, c, g, or t
  misc_feature (736)..(736): n is a, c, g, or t
  misc_feature (786)..(786): n is a, c, g, or t
  misc_feature (801)..(801): n is a, c, g, or t
  misc_feature (804)..(804): n is a, c, g, or t
  misc_feature (808)..(808): n is a, c, g, or t
  misc_feature (823)..(823): n is a, c, g, or t
ttattaaagaggagaaatnactatgagaggatcgcatcaccatcaccatcacggatcctatttaggtgacactatagaatcgtcgacccacgcgtccgcccacgcgtccggcgacacagccatcgtgcccatcggctaccatgtgccccgcaaggctgtggagttccacgaggacctgttcccggacactgccggctgtgtgcctgccaccgacccccatagctggtgggctggggacaaccagcaggtgcagaaggtcagcctcaaccccgcctgccggccccacccgagcttcacttcctgtctggtgccccctgcggagcccctccctgacacagcccagcctgcggtgatggagacacccgtgggtgatgcagacgcaagcgagggtttctcttcccctcccagttcgctgacctcgccctccacgccctccagcctggggccctcactctccagcaccagtggcatcgggaccagccccagtttgaggtcgctgcagagcctgctgggccccagttccaagttccgccatgctcagggcactgtcctgcaccgagacagccacatcaccaacctcaaggggctcaacctcaccacacctggtgagagtgacggcttctgtgccaacaagctgcgtgtggccgtgccgctgctcagcagcgggggacaggtggctgtgcttgagctacggaagcctggccgcctgcccgacacggcactgcccacgctgcanatggggcagctgtgactgatctggcctggggacccctttgaccccatcgncttgctggggctggngangacnccaggatccgactgnggcgggtacccgcaaagggcctg

SEQ ID NO: 120 - DNA, 1184 bp, Human
  misc_feature (70)..(70): n is a, c, g, or t
  misc_feature (923)..(923): n is a, c, g, or t
  misc_feature (937)..(937): n is a, c, g, or t
  misc_feature (980)..(980): n is a, c, g, or t
  misc_feature (986)..(986): n is a, c, g, or t
  misc_feature (994)..(994): n is a, c, g, or t
  misc_feature (997)..(997): n is a, c, g, or t
  misc_feature (1003)..(1003): n is a, c, g, or t
  misc_feature (1025)..(1025): n is a, c, g, or t
  misc_feature (1029)..(1029): n is a, c, g, or t
  misc_feature (1043)..(1043): n is a, c, g, or t
  misc_feature (1049)..(1049): n is a, c, g, or t
  misc_feature (1055)..(1056): n is a, c, g, or t
  misc_feature (1063)..(1063): n is a, c, g, or t
  misc_feature (1074)..(1074): n is a, c, g, or t
  misc_feature (1086)..(1086): n is a, c, g, or t
  misc_feature (1100)..(1100): n is a, c, g, or t
  misc_feature (1106)..(1106): n is a, c, g, or t
  misc_feature (1127)..(1127): n is a, c, g, or t
  misc_feature (1130)..(1130): n is a, c, g, or t
  misc_feature (1138)..(1138): n is a, c, g, or t
  misc_feature (1143)..(1143): n is a, c, g, or t
  misc_feature (1153)..(1153): n is a, c, g, or t
  misc_feature (1159)..(1159): n is a, c, g, or t
  misc_feature (1163)..(1163): n is a, c, g, or t
  misc_feature (1169)..(1169): n is a, c, g, or t
  misc_feature (1178)..(1178): n is a, c, g, or t
  misc_feature (1184)..(1184): n is a, c, g, or t
tatagagaaattactatgagaggatcgcatcaccatcaccatcacggatcctatttaggtgacactatanaatcgtcgacccacgcgtccgcccacgcgtccgcacaggtgacacaaacaaagtttctccccaatgctccgaaagctctcattgttgaaccttcccgggagttagctgaacaaactttgaataacatcaagcagtttaagaaatacattgataatcctaaattaagggagcttctgataattggaggtgttgcagcccgggatcagctctctgttttggaaaatggagtagatatagttgtaggtactccgggaagactagatgacttggtgtcaactggaaagctgaacttatctcaagttagattcctggtcctggatgaagctgatgggcttctttctcaaggttattctgattttataaataggatgcacaatcagattcctcaggttacctctgatggaaaaagacttcaggtgattgtttgctctgccactttgcattctttcgatgtaaagaaactgtccgagaagataatgcattttcctacatgggttgacttaaaaggagaagactctgttccagatactgtacaccatgttgttgtcccagtaaatcccaaaactgacagactctgggaaaggcttggaaagagccacattagaactgatgatgtacatgcaaaagataacacaagacctggtgctaatagtccagagatgtggtctgaagctattaaaatcctgaaaggggagtatgctgtccgggcaatcaaggaacataagatggatcaagcaattatcttctgtagaaaccaaaaattgactgtgataacttggagcagtactttatacaacaaggaggaggacctgataaaaaaggacaccagttctcatgtggttgtcttcatggngacagaaagcctcntgagagaaagcaaacttggaaagatttaagaaaggggatgtanattctngatttgcncanatgtanctgctaaaggaattgatatccncggngttccttatgttanaaatgncccccnngcccgangaaaagcaaanctacgtacatcnaattggcaaaatangaaaanctgaaaggatgggtctggcanttncctggggncaaanaaaaaaaaangttggnaccntgtttntaacccccnggaaan

SEQ ID NO: 121 - DNA, 850 bp, Human
  misc_feature (701)..(701): n is a, c, g, or t
  misc_feature (708)..(709): n is a, c, g, or t
  misc_feature (743)..(743): n is a, c, g, or t
  misc_feature (774)..(774): n is a, c, g, or t
  misc_feature (803)..(803): n is a, c, g, or t
cccccatagagaaatactagagaggatgcatcaccatcaccatcacggatcctatttaggtgacactatagaatcgtcgactctggaccttggctgtcactcagttaagggcccgcagcctacggtaaaacctgacctggtagggaagctgtccagatgcggccacgtctaccacatctactgcttggttgccatgtacaacaatgggaacaaggatggaagtttgcagtgtccaacctgcaagaccatttatggggtgaagacaggcacccaacctccagggaagatggagtaccacctcatcccccactccttgcctggccacccagactgcaaaaccatccggatcatctacagcatcccccccggcattcagggaccggaacacccgaatcctgggaagagtttcagcgcccgaggcttcccacgacactgttaccttccggacagcgagaaagggagaaaagttctgaagctgctgctcgtggcctgggatcgccgcctcatttttgccattggcacctccagcaccacaggcgagtcagacaccgtcatctggaatgaggtccaccacaagacagagtttggctctaatctcactggccatggctacccagatgccaattacctggataatgtgctggctgaactggctgcccagggcatctctgaggacagcactgcccaggagaaggactgangccagannagctttgaggtgggaggggccatggagactgcangacaggaaagtgagagagtgagtcaatgtanaagaagttggtgtcctgccctccaacttnctatcctccctcctgcctgtgtccatcctcatcctccccacacagtg

SEQ ID NO: 122 - DNA, 865 bp, Human
  misc_feature (1)..(2): n is a, c, g, or t
  misc_feature (857)..(858): n is a, c, g, or t
nnttatagagagaatactatgagaggatgcatcccatcaccatcacggatcctatttaggtgacactatagaatcgtcgactctggaccttggctgtcactcagttacaacgtgtgatgccattagtgtattggagaaagaacatgactactcagatgaccgttttgattttattcagtcacatatccggaagttttgtttacagtatggtgcggcacttatttacactctcctgagagatcacaccaaaatacacttatgatataaatacttccttcataaactatatggatttccctatacgattcctgctgttgttgtggaaaaggatgcagtatttattccagcacggtgggataatgataagaaaataggactattacatgaagattttcaaacattaaaggcagaagataattttgaagacatcataactaacccacctgttcgaacgtttgtacatgagaaggatattatggcggaagatgatcaggtgtttcttatgaagctacagtcccttttagcagagcaaccaccaactgcagctggaacgccggtggatgcctcaccaagagtcccaggaggctccccacgaacaccagatatatctgtatcatctaatgttgccaacgagtcacccattcctgctgggtcagacaacattgatccatacatggaagctggagctacgagtgaaggcgttctggcagatttcttcaacacgtgtgtgagtaacaagactggctctccacgaggcactggtgtgagtggtgctagtcctgcacgtggagctggaggtgaagcactggtttacaccatccacaaaagtcaggcaaaagctgtcgtagatgtctgcnnactagac

SEQ ID NO: 123 - DNA, 827 bp, Human
  misc_feature (645)..(645): n is a, c, g, or t
  misc_feature (746)..(746): n is a, c, g, or t
  misc_feature (755)..(755): n is a, c, g, or t
  misc_feature (781)..(781): n is a, c, g, or t
  misc_feature (801)..(801): n is a, c, g, or t
  misc_feature (811)..(811): n is a, c, g, or t
cttaagaggagaattaactatgagaggatcgcatcaccatcaccatcacggatcctatttaggtgacactatagaatcgtcgacccacgcgtccgcgactgtcgaaccggaaaccacccctactcctaatcccccgactacagaagaggagaaaacggaatctaatcaggaggttgctaacccagaacactatattaaacatcccctacagaacagatgggcactctggttttttaaaaatgataaaagcaaaacttggcaagcaaacctgcggctgatctccaagtttgatactgttgaagacttttgggctctgtacaaccatatccagttgtctagtaatttaatgcctggctgtgactactcactttttaaggatggtattgagcctatgtgggaagatgagaaaaacaaacggggaggacgatggctaattacattgaacaaacagcagagacgaagtgacctcgatcgcttttggctagagacacttctgtgccttattggagaatcttttgatgactacagtgatgatgtatgtggcgctgttgttaatgttagagctaaaggtgataagatagcaatatggactactgaatgtgaaaacagagaagctgttacacatatagggagggtatacaaggnaaaggttaggacttcctccaaagatagtgattggttatcagtcccacgcagacacagctactaagagcggctccaccactaaaaaaatagggtttggttgnttaagaaanacacccttctgagtattctcataggnagactgcgtcaagcaatcgnagatttgggnagctgaaccaaagcct

SEQ ID NO: 124 - DNA, 936 bp, Human
  misc_feature (1)..(6): n is a, c, g, or t
  misc_feature (768)..(768): n is a, c, g, or t
  misc_feature (866)..(866): n is a, c, g, or t
  misc_feature (881)..(881): n is a, c, g, or t
  misc_feature (893)..(893): n is a, c, g, or t
  misc_feature (896)..(896): n is a, c, g, or t
  misc_feature (899)..(900): n is a, c, g, or t
  misc_feature (903)..(903): n is a, c, g, or t
  misc_feature (905)..(906): n is a, c, g, or t
  misc_feature (908)..(909): n is a, c, g, or t
  misc_feature (921)..(921): n is a, c, g, or t
  misc_feature (931)..(932): n is a, c, g, or t
  misc_feature (935)..(935): n is a, c, g, or t
nnnnnnggcgcggggccccctaagaatactagagaggatcgcatcaccatcaccatcacggtcgacccacgcgtccggacctggcccagggcttctcccctgtaatccagggccacactgatgagctctgggggctctgcacacacccctcccagaaccgcttcctcacctgcggccacgaccggcagctctgcctgtgggatggggagagccatgcactggcctggagcatcgacctcaaggagactggtctctgtgctgacttccacccgagtggggcagttgtggccgtaggactgaacacggggaggtggttggttttggacacagagaccagagagatcgtgtctgatgtcattgatggcaatgagcagctctcagtggtccggtacagcccagatgggttgtacctggccattggttcccatgacaacgtgatctacatctatagtgtttccagtgatggtgccaaatccagccgctttggccgctgtatgggtcactccagcttcatcactcatcttgactggtccaaggatgggaatttcatcatgtccaattctggggactatgagattctttactgggacgtggctggaggctgcaagcagctgaagaatcgctatgagagccgagaccgggaatgggctacctacacctgtgtgctgggctttcacgtctacggtgagcaggggcgtggaaacctgctggaagggtgggggacaaggtggagcccagtttgggcttggaacgctgggcgtgtgtcgntgggtgagagtccaaaaacctgaagatccagcccaggaagcccctcgggaacgggaaagcttgcctggaacgcggcagtgggtggccccggctgccgnaaaccctgaaatggngaaactctgggnccnggnnggngnngnntaaaaagatccncctaaccccnnccnt

SEQ ID NO: 125 - DNA, 920 bp, Human
  misc_feature (739)..(739): n is a, c, g, or t
  misc_feature (759)..(759): n is a, c, g, or t
  misc_feature (765)..(765): n is a, c, g, or t
  misc_feature (767)..(767): n is a, c, g, or t
  misc_feature (773)..(773): n is a, c, g, or t
  misc_feature (782)..(783): n is a, c, g, or t
  misc_feature (795)..(795): n is a, c, g, or t
  misc_feature (802)..(803): n is a, c, g, or t
  misc_feature (818)..(818): n is a, c, g, or t
  misc_feature (836)..(836): n is a, c, g, or t
  misc_feature (868)..(868): n is a, c, g, or t
  misc_feature (873)..(874): n is a, c, g, or t
  misc_feature (876)..(876): n is a, c, g, or t
  misc_feature (885)..(885): n is a, c, g, or t
  misc_feature (887)..(887): n is a, c, g, or t
  misc_feature (889)..(891): n is a, c, g, or t
  misc_feature (897)..(898): n is a, c, g, or t
  misc_feature (901)..(901): n is a, c, g, or t
  misc_feature (910)..(910): n is a, c, g, or t
  misc_feature (914)..(914): n is a, c, g, or t
caatagagagaattactatgagaggatcgcatcaccatcaccatcacggatcctatttaggtgacactatagaatcgtcgacccacgcgtccggccgccgccgccgccgccgccgggtcgcccctggcccggcgcgcccgtccccggcagcgacaatgagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccantggggctaccccactccccnaccccnantgccanccggaggannccaggggtccanccacgannagagctccatgtcangactggccgctgccatanctggggccaactgaaaaaattcaaacggccanaaaanncntctggaagntncnnntcccannggnacttcaaantccnatgcca

SEQ ID NO: 126 - DNA, 1242 bp, Human
  misc_feature (2)..(2): n is a, c, g, or t
  misc_feature (819)..(819): n is a, c, g, or t
  misc_feature (909)..(909): n is a, c, g, or t
  misc_feature (911)..(911): n is a, c, g, or t
  misc_feature (926)..(927): n is a, c, g, or t
  misc_feature (929)..(929): n is a, c, g, or t
  misc_feature (935)..(935): n is a, c, g, or t
  misc_feature (942)..(942): n is a, c, g, or t
  misc_feature (960)..(960): n is a, c, g, or t
  misc_feature (965)..(965): n is a, c, g, or t
  misc_feature (968)..(968): n is a, c, g, or t
  misc_feature (971)..(971): n is a, c, g, or t
  misc_feature (981)..(981): n is a, c, g, or t
  misc_feature (995)..(995): n is a, c, g, or t
  misc_feature (1000)..(1000): n is a, c, g, or t
  misc_feature (1008)..(1008): n is a, c, g, or t
  misc_feature (1020)..(1021): n is a, c, g, or t
  misc_feature (1027)..(1029): n is a, c, g, or t
  misc_feature (1035)..(1035): n is a, c, g, or t
  misc_feature (1053)..(1053): n is a, c, g, or t
  misc_feature (1063)..(1063): n is a, c, g, or t
  misc_feature (1066)..(1066): n is a, c, g, or t
  misc_feature (1081)..(1081): n is a, c, g, or t
  misc_feature (1083)..(1083): n is a, c, g, or t
  misc_feature (1086)..(1086): n is a, c, g, or t
  misc_feature (1095)..(1095): n is a, c, g, or t
  misc_feature (1101)..(1101): n is a, c, g, or t
  misc_feature (1104)..(1104): n is a, c, g, or t
  misc_feature (1115)..(1115): n is a, c, g, or t
  misc_feature (1121)..(1121): n is a, c, g, or t
  misc_feature (1124)..(1124): n is a, c, g, or t
  misc_feature (1135)..(1135): n is a, c, g, or t
  misc_feature (1141)..(1141): n is a, c, g, or t
  misc_feature (1146)..(1146): n is a, c, g, or t
  misc_feature (1157)..(1157): n is a, c, g, or t
  misc_feature (1164)..(1164): n is a, c, g, or t
  misc_feature (1168)..(1168): n is a, c, g, or t
  misc_feature (1171)..(1171): n is a, c, g, or t
  misc_feature (1180)..(1180): n is a, c, g, or t
  misc_feature (1191)..(1191): n is a, c, g, or t
  misc_feature (1195)..(1195): n is a, c, g, or t
  misc_feature (1198)..(1198): n is a, c, g, or t
  misc_feature (1206)..(1206): n is a, c, g, or t
  misc_feature (1209)..(1209): n is a, c, g, or t
  misc_feature (1211)..(1211): n is a, c, g, or t
  misc_feature (1221)..(1221): n is a, c, g, or t
  misc_feature (1231)..(1231): n is a, c, g, or t
  misc_feature (1239)..(1239): n is a, c, g, or t
  misc_feature (1241)..(1241): n is a, c, g, or t
antagagaaattactatgagaggatcgcatcaccatcaccatcacggatcctatttaggtgacactatagaatcgtcgacccacgcgtccgcggacgcgtggggccgcggctgcggccactgcgcgctactccatggacagcctgagctccgagcggtactacctccagtcccccggtcctcaggggtcggagctggctgcgccctgctcactcttcccgtaccaggcggcggctggggcgccccacggacctgtgtacccggctcctaacggggcgcgctacccctacggctccatgctgccccccggcggcttccccgcggctgtgtgcccacccgggagggcgcagttcggcccaggagccggtgcgggcagtggcgcgggcggtagcagcggcgggggcggcggcccgggcacctatcagtacagccagggggctccgctctacgggccgtaccctggagccgcagcggcgggatcttgcggaggactggggggcctgggggttccaggttctggcttccgtgcccacgtctacctgtgcaaccggcctctgtggctcaaattccaccgccaccaaactgagatgatcattacgaaacagggcaggcgcatgtttcctttcttgagcttcaacataaacggactcaatcccactgcccactacaatgtgttcgtaaaggtggtgctggcggaccccaaccactggcgcttccaggggggcaaatgggtgacctgtggcaaagccgacaataacatgcagggcaacaaaatgtatgttcacccagagtctcctaatactggttcccactggatganacaggagatttcattcgggaaattaaaactcaccaataacaaaggcgcaaataacaacaacacccagatgatagtcttacaatcctttananaaataccaaaccccnnantgcaanattgttnaaattaaaaaagaatggngttgnaanaanttgaatgaancccttaaaaaaccnaaaantttttacntttttcaaaaanncaattnnnttgcantgactgcctaccaaaaanccgatattantcnaataaaaaattgatntnaancccctttgnaaaagnttncaaaaaaaatnataatnccnttaaacccttnaaaaanaaaangtaaattcttncccccgnaatnccnaaaatccanaaaaattcccngaangcngaaagggnttnantcttttttcnaaaccttttnaaaatttnant

SEQ ID NO: 127 - DNA, 918 bp, Human
tgagaggatcgcatcaccatcaccatcacggatcctatttaggtgacactatagaatcgtcgacccacgcgtccggcgccgcgagcgaggccggccgcgccatgcacctgatgaagaagcgggagaagcagcgcgagcagatggagcagatgaagcagcgcatcgcggaggagaacatcatgaaatccaacattgacaagaagttctctgcgcactacgacgcggtggaggcagagctcaagtccagcaccgtgggtctcgtgaccctgaatgacatgaaggccaagcaggaggctctggtgaaggagcgggagaagcagctggccaagaaggagcagtccaaggagctgcagatgaagctggagaagcttcgagagaaggagcgtaagaaggaagccaagcggaagatctccagcctgtccttcaccctggaggaggaagaagagggaggcgaggaggaagaggaggcggccatgtatgaggaggagatggaaagggaagagacggaatctcgccatgttgcccaagctggtctcgaacttgggagctactggcgtggacagtgcaggcctgggggaaagagatcaccacgaagaagagaaaactggggaagaacccagacgttgacacaagcttcttgcctgatcgagaccgtgaggaggaggagaatcggcttcgggaagagctgcggcaggagtgggaagccaagcaggagaagatcaagagtgaggagatcgagatcaccttcagctactgggatggctctgggcaccggcggacagtcaaggtaggcagcgtgcagcctgcttcctgctcaccatgggcccagcctccctcacgttccgtgggaaggaactgaccttcctgacttgggaagccccagggatcctgaggataactggctccagggcctgcccc

SEQ ID NO: 128 - DNA, 1428 bp, Human
  misc_feature (933)..(933): n is a, c, g, or t
  misc_feature (988)..(988): n is a, c, g, or t
  misc_feature (1069)..(1069): n is a, c, g, or t
  misc_feature (1197)..(1197): n is a, c, g, or t
  misc_feature (1243)..(1243): n is a, c, g, or t
  misc_feature (1257)..(1257): n is a, c, g, or t
  misc_feature (1337)..(1337): n is a, c, g, or t
gggcggccccaagagatactagagaggatgcatcaccatcaccatcacggtcgacccacgcgtccggcagaaggcgtggctggcaagagtggcctggagaaagaggttcagcgcttgaccagccgagctgcccgtgactacaagatccagaaccatgggcatcgggtactgcaacgactggagcagaggcggcagcaggcttcagagcgggaggctccaagcatagaacagaggttacaggaagtgcgagagagcatccgccgggcacaggtgagccaggtgaagggggctgcccggctggccctgctgcagggggctggcttagatgtggagcgctggctgaagccagccatgacccaggcccaggatgaggtggagcaggagcggcggctcagtgaggctcggctgtcccagagggacctctctccaaccgctgaggatgctgagctttctgactttgaggaatgtgaggagacgggagagctctttgaggagcctgccccccaagccctggccacgagggccctcccctgccctgcacacgtggtatttcgctatcaggcagggcgtgaggatgagctgacaatcacggagggtgagtggctggaggtcatagaggagggagatgctgacgaatgggtcaaggctcggaaccagcacggcgaggtaggctttgtccctgagcgatatctcaacttcccggacctctccctcccagagagcagccaagacagtgacaatccctgcggggcagagcccacagcattcctggcacaggccctgtacagctacaccggacagagtgcagaggagctgagcttccctgagggggcactcatccgtctgctgccccgggcccaagatggagtagatgacggcttctggaggggaaaattttggggcccgggtggggtctccccctcctgctggggnaaaacctcttggcccccccggccccctgacctctcaaccccaaacgaagttgcgnccccttctccccccaattcccccccctgccaaaccctgggattgaatgacccctgaacctcaccccctggaacaccccggnatttccggccttctaactagagccccccacacccgctacatccctcctctcctgccaccccctggatctctcccccaaccctcttgatcattccattccccctaacctctccaccactccttttccancccctcccatctacccccactaccgcttacccctcctcgcgtcacngtcatgccctccantcacccaaccttccttccccactctctgctctcccccctctccaccccctcgcttccttccccgacccttccccacctcncgccctctcacttcaccgccacccgtaaggtcctctccgcaccgccagccccctctcaacctgaactcctcgcaccccaccccccaccctc

SEQ ID NO: 129 - DNA, 1341 bp, Human
  misc_feature (1)..(3): n is a, c, g, or t
nnnttggcatatactgacttacctataaataggcgtatcacgaggccctttcgtcttcacctcgagaaatcataaaaaatttatttgctttgtgagcggataacaattataatagattcaattgtgagcggataacaatttcacacagaattcattaaagaggagaaattaactatgagaggatcgcatcaccatcaccatcacggtcgacccacgcgtccgacgggggggacttgcggagccatccggagcagaccacttcaccaccgctcatggtgcgcgcgtctcgggctccgggccgggcagctgaggggcggcgggcgcgctcccgacacagccgacgcctgccgagcgcgcagtggcgagaacctagctctcctggtcgcgcaccccggacggactgggcggacagactccacggtgcgcgggttccacgagttcgagtctctcctctgcaggcccacgaacctgaacagaacgcgagccggggccgcgggcgcgccggcctcctttcagtgcgcccgcctcgcctccagacgtgccgtctcgccagctgcctcagcagcgctcggactcagcgggactctgccccgactcggtgccggagcttctgtcctttgcgctccgccccctagggacaagacctccccagagcgctttccgaaacagacacagcgctgctcacacacacacacacacacacacacacacacacacaatgccccgcgcggtgcccgctcgcccgcccacccgccctcggtttcgatgcgcccggagcgatcctccttccctctcctcgggggaaggtgggtcacttcccggcgctcgggaaacgccgagaaaaggggagcccgcaagccgcctacgggcaacgggcgcggggctggtccccggtcccaaaaagaacccgaaggtttggcaaccaaacccggggcgtttttaaacggcgggcgcaaggaaggtcccaggccaacccgaagggggggtcccccccccccgcccccccaaaaaggcggggaaacaacaaaagaacaaggccctttgggcgtcttggctctcggaagagaaacccctttttccccgccactttgtgctcttcccccggccatttcccccacccgggtctcttacggggcctctacaggtgtcccccaccaaaaaccaaatctctcccaaccccctccccgcgcacaagcctcctaaagctctaaccatactgctagtccccctccgtaaacaactcaaaacaccccatctctctctccggcctgcgatatataaaccccctatctagctcacatcattactcacacactactctatcacatctcatgaatcctt

SEQ ID NO: 130 - DNA, 867 bp, Human
  misc_feature (757)..(757): n is a, c, g, or t
agagagatactatgagaggatgcatcaccatcaccatcacggatcctatttaggtgacactatagaatcgtcgactctggaccttggctgtcactcagtttggcagctgggggtgggcgccgtccgtacgctgcgcactggacccgctctgctctcggtgcgtaaattcacagagaaacacgaatgggtaacaacagaaaatggcattggaacagtgggaatcagcaattttgcacaggaagcgttgggagatgttgtttattgtagtctccctgaagttgggacaaaattgaacaaacaagatgagtttggtgctttggaaagtgtgaaagctgctagtgaactctattctcctttatcaggagaagtaactgaaattaatgaagctcttgcagaaaatccaggacttgtaaacaaatcttgttatgaagatggttggctgatcaagatgacactgagtaacccttcagaactagatgaacttatgagtgaagaagcatatgagaactacataaaatctattgaggagtgaaaatggaactcctaaataaactagtatgaaataacgcaagccagcagagttgtcttaaattagtggtggatagaagacttagaatagaaacttttagtattaccgatggggaaaaaaaactactgttaacactgctaatgaaagaaaatgccctttaactttctaaatgatatagataaatataatatgcgtctttttcacaatatcctatgatttttagactangctctagtggtcagaaatcatgaaattatccatggtaaaactagttataaaaatacataattcaagataacatttgtatctaaagcctatatatatgtaactgcatgtat

SEQ ID NO: 131 - DNA, 1191 bp, Human
  misc_feature (1)..(1): n is a, c, g, or t
  misc_feature (870)..(870): n is a, c, g, or t
  misc_feature (891)..(891): n is a, c, g, or t
  misc_feature (906)..(906): n is a, c, g, or t
  misc_feature (916)..(916): n is a, c, g, or t
  misc_feature (921)..(921): n is a, c, g, or t
  misc_feature (954)..(954): n is a, c, g, or t
  misc_feature (967)..(967): n is a, c, g, or t
  misc_feature (973)..(973): n is a, c, g, or t
  misc_feature (989)..(989): n is a, c, g, or t
  misc_feature (1005)..(1005): n is a, c, g, or t
  misc_feature (1007)..(1007): n is a, c, g, or t
  misc_feature (1025)..(1025): n is a, c, g, or t
  misc_feature (1028)..(1028): n is a, c, g, or t
  misc_feature (1033)..(1033): n is a, c, g, or t
  misc_feature (1035)..(1035): n is a, c, g, or t
  misc_feature (1037)..(1037): n is a, c, g, or t
  misc_feature (1050)..(1050): n is a, c, g, or t
  misc_feature (1053)..(1053): n is a, c, g, or t
  misc_feature (1059)..(1059): n is a, c, g, or t
  misc_feature (1076)..(1076): n is a, c, g, or t
  misc_feature (1085)..(1086): n is a, c, g, or t
  misc_feature (1116)..(1116): n is a, c, g, or t
  misc_feature (1121)..(1121): n is a, c, g, or t
  misc_feature (1123)..(1123): n is a, c, g, or t
  misc_feature (1135)..(1135): n is a, c, g, or t
  misc_feature (1140)..(1140): n is a, c, g, or t
  misc_feature (1143)..(1143): n is a, c, g, or t
  misc_feature (1146)..(1148): n is a, c, g, or t
  misc_feature (1154)..(1154): n is a, c, g, or t
  misc_feature (1163)..(1163): n is a, c, g, or t
  misc_feature (1187)..(1187): n is a, c, g, or t
naattagagaaattactatgagaggatcgcatcaccatcaccatcacggatcctatttaggtgacactatagaatcgtcgacccacgcgtccgcggacgcgtgggcccggctgctcaaggagctgccccgaggccgtaccttcacgctgaagctcacggagcctcgcaaggccttcgacatgatcagccagcgttcagcgggtggccgccctggctctggcccacaactgggcactggccgagggaccctgcggctccgatcccggggccccgccacggtggaggatctgccctctgcctttgaagagaaggccattgagaaggtggatgacctgctggagagttacatgggtatcagggacacggagctggcggccaccatggtggagctgggaaaggacaaaaggaacccggatgagctggccgaggccctggacgaacggctgggtgactttgccttccctgacgagttcgtctttgacgtctggggcgccattggggacgccaaggtcggccgctactaggactgcccccggaccctgcgatgatgacccgggcgcaacctggtgggggcccccagcagggacactgacgtcaggacccgagcctccagcctgagcctagctcagcagcccaaggacgatggtgaggggaggtggggccaggccccctgccccgctccactcggtaccatcccctccctggttcccagtctggccggggtccccggcccccctgtgccctgttccccacctacctcagctgggtcaggcacagggaggggagggatcagccaaattgggcggccacccccgcctccaccactttccaccatcagctgccaaactggtcccctctgtctccctgggnccttgggttctgtttgggggntcatgaccttcctantttcctgacncaggnaataaaggggaaaaggttgtcctttccccccancaatgcaaaatgnccttcncccctcctgaaagaancccctccctgtggaancntgtttacctccccatttnaanccaantntnttgggaaccccgnaanctcctnccaacttccattttttnttcagggcnntcctgggcccaaaaaggaggaagggagganaaggncngggggttttttnatctnaanttnnnttttgnaaaaaaaantctttctccaaaaaaaaaaaaggnggcc

SEQ ID NO: 132 - DNA, 1120 bp, Human
  misc_feature (750)..(750): n is a, c, g, or t
  misc_feature (753)..(753): n is a, c, g, or t
  misc_feature (786)..(786): n is a, c, g, or t
  misc_feature (829)..(829): n is a, c, g, or t
  misc_feature (834)..(834): n is a, c, g, or t
  misc_feature (836)..(836): n is a, c, g, or t
  misc_feature (840)..(840): n is a, c, g, or t
  misc_feature (852)..(852): n is a, c, g, or t
  misc_feature (858)..(858): n is a, c, g, or t
  misc_feature (864)..(864): n is a, c, g, or t
  misc_feature (874)..(874): n is a, c, g, or t
  misc_feature (880)..(880): n is a, c, g, or t
  misc_feature (902)..(902): n is a, c, g, or t
  misc_feature (911)..(911): n is a, c, g, or t
  misc_feature (922)..(922): n is a, c, g, or t
  misc_feature (926)..(926): n is a, c, g, or t
  misc_feature (940)..(940): n is a, c, g, or t
  misc_feature (950)..(950): n is a, c, g, or t
  misc_feature (956)..(956): n is a, c, g, or t
  misc_feature (966)..(966): n is a, c, g, or t
  misc_feature (968)..(968): n is a, c, g, or t
  misc_feature (977)..(977): n is a, c, g, or t
  misc_feature (986)..(986): n is a, c, g, or t
  misc_feature (988)..(988): n is a, c, g, or t
  misc_feature (990)..(990): n is a, c, g, or t
  misc_feature (999)..(999): n is a, c, g, or t
  misc_feature (1004)..(1004): n is a, c, g, or t
  misc_feature (1016)..(1016): n is a, c, g, or t
  misc_feature (1043)..(1043): n is a, c, g, or t
  misc_feature (1047)..(1047): n is a, c, g, or t
  misc_feature (1062)..(1062): n is a, c, g, or t
  misc_feature (1072)..(1072): n is a, c, g, or t
  misc_feature (1074)..(1074): n is a, c, g, or t
  misc_feature (1078)..(1078): n is a, c, g, or t
  misc_feature (1086)..(1086): n is a, c, g, or t
  misc_feature (1093)..(1094): n is a, c, g, or t
  misc_feature (1097)..(1097): n is a, c, g, or t
  misc_feature (1103)..(1103): n is a, c, g, or t
  misc_feature (1107)..(1107): n is a, c, g, or t
  misc_feature (1110)..(1113): n is a, c, g, or t
  misc_feature (1116)..(1116): n is a, c, g, or t
tagagaaattactatgagaggatcgcatcaccatcaccatcacggatcctatttaggtgacactatagaatcgtcgacccacgcgtccggccagagtgacctcgacgaccaacacgactacgacagcgtggcctctgacgaggacacagaccaggagcccctgcgcagcaccggcgccactcggagcaaccgggcccggagcatggactcctcggacttgtctgacggggctgtgacgctgcaggagtacctggagctgaagaaggccctggctacatcggaggcaaaggtgcagcagctcatgaaggtcaacagtagcctgagcgacgagctccggaggctgcagcgagagatccacaagctgcaggcggagaacctgcagctccggcagcctccagggccggtgcccacacctccactccccagtgaacgggcggaacacacacccatggcgccaggcgggagcacacaccgcagggatcgccaggccttttccatgtatgaacctggctctgccctgaagccctttgggggcccccctggggacgagctcactacgcggctgcagcctttccacagcactgagctagaggacgacgccatctattcagtgcacgtccctgctggcctttaccggatccggaaaggggtgtctgcctcagctgtgcccttcactccctcctccccgctgctgtcctgctcccaggagggaagccgccacacgagcaagctttcccgccacggcagtgnagncgacagtgactatgagaacacgcaaagtggggnacccactgctggggctggaagggaaaaagtttctagagctggncaaanangaanacttccacccanagctgnaaagcntggatggaanacctanatcctggggcttcccagcacanaggatgtcntcttgaagaanaganccaggtcaccaaanaatatttcangaactnttgccggcancncaagaattnaagcatganancnttcgtgccntgctnaaaaaaaatccntttggctgtgaccgaaatggccccccncttncccaaaaaaggccancccctggaancnagtnggggaaanttcgttnnggnttgttnaaanccnnnnccntaac

SEQ ID NO: 133 - DNA, 924 bp, Human
agaggatcgcatcaccatcaccatcacggatcctatttaggtgacactatagaatcgtcgacccacgcgtccgcagagaatcgttatgatgtgaaccgtcgacgacacaactcttcagatggctttgattctgctattgggcgtcctaatggaggtaactttggaaggaaagaaaaaaatggatggcgtacacatggaagaaatggtacagaaaacataaatcatcgaggtggataccatggtggaagttcccgttctcgtagcagtattttccatgcaggaaaaagccaaggactacatgaaaacaacatacctgacaatgaaaccgggaggaaagaagacaagagagaacgcaaacagtttgaagctgaggattttccgtctttaaatcctgagtatgagagagaaccaaatcacaataagtctttagctgcaggtgtgtggggcctacacgcccagacacacacatacccaaccaaaaaaatctcccaagctcctctcttagaatatcctccgaatcctaaatctagagctccaaggatgctggtcattaagaaaggtaatacaaaagacttacagctatctggattcccagtagtaggaaatcttccgtcacagccagttaagaatggaactggtccaagtgtttataaaggtttagtccctaaacctgctgctccacctacaaaacctacacaatggaaaagccaaacaaaagaaaataaagttggaacttctttccctcatgagtccacatttggcgttggcaactttaatgcttttaaatcaactgccaagaactttagtccatctacaaattcagtgaaagagtgtaatcgctcaaattcctcttctcctgttgacaaacttaatcagcagcctcgtctaaccaaactgacacgaatgcgcactgataagaagagt

SEQ ID NO: 134 - DNA, 893 bp, Human
  misc_feature (721)..(721): n is a, c, g, or t
  misc_feature (743)..(743): n is a, c, g, or t
  misc_feature (767)..(767): n is a, c, g, or t
  misc_feature (782)..(782): n is a, c, g, or t
ccagcatagagagaatactatgagaggatgcatcccatcaccatcacggatcctatttaggtgacactatagaatcgtcgactctggaccttggctgtcactcagttaagttcaagggcatcaagaagggaggcgtaacagagaacacgtcctactacatcttcacccagtgccccgacggggccttcgaggccttccccgtgcacaactggtacaatttcacaccgctggcccggcatcgcacgctcactgccgaggaggccgaggaggagtgggagaggaggaacaaggtgctgaaccacttcagcatcatgcagcagcggcggctcaaggatcaggaccaggacgaggatgaggaggagaaggagaaacgtggccgcaggaaggcgagcgagctgcgcatccacgacctggaggacgacctggagatgtcgtccgatgccagtgatgccagtggtgaggaggggggcagagtccccaaggccaagaagaaggcgccgctggccaagggcggcaggaaaaagaagaagaagaagggttcagacgacgaggccttcgaggacagcgatgatggggacttcgagggccaagaggtggactacatgtcagacggctccagtagctcccaagaagagcctgagagcaaggccaaggcgccgcagcaggaggaggggcccaagggtgtcgatgagcagagcgacagtagtgaggagagtgaggnagagaagccgcctgaggaggancagggagaggagggagagacgaangcacccaccccgcangagaagaagcgcaggaaagacagcagcgaggagtcggacagctcagaagagagcgacattgacagcgaggcctcctcagccctctcatggcgaagagaagacgcaccccag

SEQ ID NO: 135 - DNA, 648 bp, Human
atgtctgaaacagtgcctcccgcccccgccgcttctgctgctcctgagaaacctttagctggcaagaaggcaaagaaacctgctaaggctgcagcagcctccaagaaaaaacccgctggcccttccgtgtcagagctgatcgtgcaggctgcttcctcctctaaggagcgtggtggtgtgtcgttggcagctcttaaaaaggcgctggcggccgcaggctacgacgtggagaagaacaacagccgcattaagctgggcattaagagcctggtaagcaagggaacgttggtgcagacaaagggtaccggagcctcgggttccttcaagctcaacaagaaggcgtcctccgtggaaaccaagcccggcgcctcaaaggtggctacaaaaactaaggcaacgggtgcatctaaaaagctcaaaaaggccacgggggctagcaaaaagagcgtcaagactccgaaaaaggctaaaaagcctgcggcaacaaggaaatcctccaagaatccaaaaaaacccaaaactgtaaagcccaagaaagtagctaaaagccctgctaaagctaaggctgtaaaacccaaggcggccaaggctagggtgacgaagccaaagactgccaaacccaagaaagcggcacccaagaaaaagtaa

SEQ ID NO: 136 - DNA, 859 bp, Human
tagagagatactatgagaggtcgcatcccatcaccatcacggatcctatttaggtgacactatagaatcgtcgactctggaccttggctgtcactcagttaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctcatgatgtggggggactcgaccccctgacatggggcagcccatagcaggccttgtgcggtggggggactcgaccccctgacatggggctgcctggagcaggccgcgtgacgtggggctgcctggccgcggctcccacatggtggttcctgctgcactgatggcccaggggtctctggtatccagatggagctctcgcttcctcagcagctgtgactttcacccaggacccaggacgcagccctccgtgggcactgccggcgccttgtctgcacactggaggtcctcccttacagaggcccagcgcacatcgctggccccacaaacgttcaggggtacagccatggcagctccttctctgcggtgaaaaagtgct

SEQ ID NO: 137 - DNA, 876 bp, Human
  misc_feature (780)..(780): n is a, c, g, or t
  misc_feature (789)..(789): n is a, c, g, or t
  misc_feature (791)..(791): n is a, c, g, or t
  misc_feature (828)..(828): n is a, c, g, or t
gagagatactatgagaggtcgcatcaccatcaccatcacggatcctatttaggtgacactatagaatcgtcgactctggaccttggctgtcactcagttggggcctgtggagtttcttggacaggggccgcggggctccaggacggcgcccttagcgacaccatggcccgaaatgcagaaaaggccatgacggccttagcaagatttcgccaggctcagctggaagagggaaaagtgaaggaacgaagaccctttctggcctcagaatgtactgaactgcctaaagctgagaagtggagacgacagatcattggagagatctctaaaaaagtggctcagattcagaatgctggtttaggtgaatttcgaattcgtgacctgaatgatgaaattaacaagctgctaagggagaaaggacactgggaggtccggataaaggagctgggaggtcctgattatggaaaagttggccctaaaatgctggatcatgaaggaaaagaagtcccaggaaaccgaggttacaagtactttggagcagcaaaagatttgcctggtgttagagagctgtttgaaaaagaacctcttcctcctcccagaaagacacgtgctgagctcatgaaggcagtcgattttgagtactatggttacctagatgaagatgatggtgttattgtgcctttggaacaggaatatgaaaagaaactcagagccgagttagtggaaaagtggaaagcagagagagaggctcggctggcaagaagagaaaaggaagaggaggangaagaagangnaagagatcacatctatgcagtcacccgagaagagtcngaacgagaaggcagcccagagaaaggagggacgacagcagcagaagtc

SEQ ID NO: 138 - DNA, 1206 bp, Human
  misc_feature (1)..(2): n is a, c, g, or t
  misc_feature (4)..(4): n is a, c, g, or t
  misc_feature (964)..(964): n is a, c, g, or t
  misc_feature (966)..(966): n is a, c, g, or t
  misc_feature (998)..(998): n is a, c, g, or t
  misc_feature (1005)..(1005): n is a, c, g, or t
  misc_feature (1013)..(1013): n is a, c, g, or t
  misc_feature (1019)..(1019): n is a, c, g, or t
  misc_feature (1028)..(1028): n is a, c, g, or t
  misc_feature (1032)..(1033): n is a, c, g, or t
  misc_feature (1055)..(1055): n is a, c, g, or t
  misc_feature (1066)..(1066): n is a, c, g, or t
  misc_feature (1079)..(1079): n is a, c, g, or t
  misc_feature (1095)..(1095): n is a, c, g, or t
  misc_feature (1098)..(1098): n is a, c, g, or t
  misc_feature (1101)..(1102): n is a, c, g, or t
  misc_feature (1112)..(1112): n is a, c, g, or t
  misc_feature (1126)..(1126): n is a, c, g, or t
  misc_feature (1130)..(1131): n is a, c, g, or t
  misc_feature (1133)..(1133): n is a, c, g, or t
  misc_feature (1136)..(1137): n is a, c, g, or t
  misc_feature (1141)..(1142): n is a, c, g, or t
  misc_feature (1147)..(1147): n is a, c, g, or t
  misc_feature (1153)..(1153): n is a, c, g, or t
  misc_feature (1162)..(1163): n is a, c, g, or t
  misc_feature (1182)..(1183): n is a, c, g, or t
  misc_feature (1187)..(1187): n is a, c, g, or t
  misc_feature (1190)..(1190): n is a, c, g, or t
  misc_feature (1192)..(1192): n is a, c, g, or t
  misc_feature (1196)..(1196): n is a, c, g, or t
  misc_feature (1204)..(1204): n is a, c, g, or t
nnantagagaaattactatgagaggatcgcatcaccatcaccatcacggatcctatttaggtgacactatagaatcgtcgacccacgcgtccgggcatttaatgaaatcagtgttttgcttctctaggtaccagaccatgctggactgctggcacggggagcccagtcagagacccacgttttcagagttggtggaacatttgggaaatctcttgcaagctaatgctcagcaggatggcaaagactacattgttcttccgatatcagagactttgagcatggaagaggattctggactctctctgcctacctcacctgtttcctgtatggaggaggaggaagtatgtgaccccaaattccattatgacaacacagcaggaatcagtcagtatctgcagaacagtaagcgaaagagccggcctgtgagtgtaaaaacatttgaagatatcccgttagaagaaccagaagtaaaagtaatcccagatgacaaccagacggacagtggtatggttcttgcctcagaagagctgaaaactttggaagacagaaccaaattatctccatcttttggtggaatggtgcccagcaaaagcagggagtctgtggcatctgaaggctcaaaccagacaagcggctaccagtccggatatcactccgatgacacagacaccaccgtgtactccagtgaggaagcagaacttttaaagctgatagagattggagtgcaaaccggtagcacagcccagattctccagcctgactcggggaccacactgagctctcctcctgtttaaaaggaagcatccacacccccaactcccggacatcacatgagaggtgctgctcagattttcaggtgttgttctttccaccagcaggaagtagccgcatttgattttcatttcgacaacagaaaaaggacctcggactgcagggagccagtcttctaggcatatcctggaanangcttgtgacccaagaatgtgtctgtgtcttcnccccagngttgaccngatccncctttttcnttcnntttaaaaaagcatttatcatgnccccctgctgngggtcccccccangggtttaaaaaaaaanacnttnnaaaaaaaggnccccctcccccaanaaannancannaccnnggggngctgancccttctgnnaaactaaaaaaaaaacccnnccangtnanggtnccaggggntt

SEQ ID NO: 139 - DNA, 1145 bp, Human
  misc_feature (936)..(936): n is a, c, g, or t
  misc_feature (948)..(948): n is a, c, g, or t
  misc_feature (969)..(969): n is a, c, g, or t
  misc_feature (971)..(971): n is a, c, g, or t
  misc_feature (983)..(983): n is a, c, g, or t
  misc_feature (1009)..(1009): n is a, c, g, or t
  misc_feature (1015)..(1015): n is a, c, g, or t
  misc_feature (1042)..(1042): n is a, c, g, or t
  misc_feature (1059)..(1059): n is a, c, g, or t
  misc_feature (1068)..(1068): n is a, c, g, or t
  misc_feature (1072)..(1072): n is a, c, g, or t
  misc_feature (1084)..(1084): n is a, c, g, or t
  misc_feature (1090)..(1090): n is a, c, g, or t
  misc_feature (1097)..(1097): n is a, c, g, or t
  misc_feature (1103)..(1104): n is a, c, g, or t
  misc_feature (1106)..(1106): n is a, c, g, or t
  misc_feature (1110)..(1110): n is a, c, g, or t
  misc_feature (1117)..(1117): n is a, c, g, or t
  misc_feature (1128)..(1128): n is a, c, g, or t
  misc_feature (1133)..(1133): n is a, c, g, or t
  misc_feature (1141)..(1143): n is a, c, g, or t
agagaaattactatgagaggatcgcatcaccatcaccatcacggatcctatttaggtgacactatagaatcgtcgacccacgcgtccgcccacgcgtccgcccacgcgtccgcccacgcgtccgctcttgcaaacttgaccattccagacttagactgggaattggttcttaaagaatataagttggttccatacctcaaggataaactaaaaccaggtgctgcagaagatgatcttgttttagaagtggttataatgattggaactgtatccatggatgactcttgtgctgcattgctagccaaatctggcataatccctgcactcattgaattgctaaatgctcaacaagaagatgatgaatttgtgtgtcagataatttatgtcttctaccagatggttttccaccaagccacaagagacgtcataatcaaggaaacacaggctccagcatatctcatagacctaatgcatgataagaataatgaaatccgaaaggtctgtgataatacattagatattatagcggaatatgatgaagaatgggctaagaaaattcagagtgaaaagtttcgctggcataactctcagtggctggagatggtagagagtcgtcagatggatgagagtgagcagtacttgtatggtgatgatcgaattgagccatacattcatgaaggagatattctcgaaagacctgaccttttctacaactcagatggattaattgcctctgaaggagccataagtcccgatttcttcaatgattaccaccttcaaaatggagatgttgttgggcagcattcatttcctggcagccttggaatggatggctttggccaaccagttggcattcttggacgccctgccacagcatatggattccgccctgatgaaccttactactatggctatggatcttgataaagtatctgnttccatgtgtantctcagcttaaaaaaatctgngngggttgggttantttgggatctttgcctaataatgcangtggangtaatggggggccggggttggttttantttaaaaggtggtagcngcaaataancccngcccccctgtcntcggtnaagtacngtgganncngacnttgttcnccctcaacccnatctnggggctannnac

SEQ ID NO: 140 - DNA, 2285 bp, Human
atggcagaaccgcgtcaagaatttgaagttatggaagatcatgcaggcacctatggtctgggtgatcgtaaagatcagggtggttataccatgcatcaggatcaagagggtgataccgatgcaggtctgaaagaaagtccgctgcagaccccgaccgaagatggtagcgaagaaccgggtagcgaaaccagtgatgcaaaaagcaccccgaccgcagaagatgttaccgcaccgctggttgatgaaggtgcaccgggtaaacaggcagctgcacagccgcataccgaaattccggaaggcaccaccgctgaagaagcaggtattggcgataccccgagtctggaagatgaagcagcaggtcatgttacccaagaaccggaaagcggtaaagttgttcaagaaggttttctgcgcgaaccgggtccgcctggtctgagccatcaactgatgagcggtatgcctggtgcaccgctgctgccggaaggtccgcgtgaagcaacccgtcagccgagcggtacaggtccggaagataccgaaggtggtcgtcatgcaccggaactgctgaaacatcagctgctgggtgatctgcatcaagaaggtccgcctctgaaaggtgccggtggtaaagaacgtccgggtagcaaagaagaggttgacgaagatcgtgatgttgatgaaagcagtccgcaggatagccctccgagcaaagcaagtccggcacaggatggtcgtccgcctcagaccgcagcacgtgaagcgaccagcattccgggttttccggcagaaggtgcaattccgctgccggttgattttctgagcaaagttagcacagaaattccggcaagcgaaccggatggtccgagcgttggtcgtgcaaaaggtcaggatgctccgctggaatttacctttcatgttgaaattaccccgaacgttcagaaagaacaggcacatagcgaagaacatctgggtcgtgcagcatttccgggtgctccgggtgaaggtccggaagcacgtggtccgagcctgggtgaagataccaaagaagcagatctgccggaaccgagcgaaaaacagcctgcagcagcaccgcgtggtaaaccggttagccgtgttccgcagctgaaagcacgtatggttagcaaaagcaaagatggcaccggttccgatgataaaaaagcaaaaaccagcacccgtagcagcgcaaaaaccctgaaaaatcgtccgtgtctgagcccgaaacatccgacaccgggtagtagcgatccgctgattcagccgagcagtccggcagtttgtccggaaccgcctagcagcccgaaatatgttagcagcgttaccagccgtaccggtagcagcggtgcaaaagaaatgaaactgaaaggtgcagacggcaaaaccaaaattgcaacaccgcgtggtgcagcaccgcctggtcagaaaggtcaggcaaatgcaacccgtattccggcaaaaacccctccggcaccgaaaaccccaccgagcagcggtgaaccgcctaaaagcggtgatcgtagtggttatagcagtccgggttcaccgggtacaccgggttcacgtagccgtaccccgagtctgccgacccctccgacccgtgaaccgaaaaaagttgcagttgttcgtacccctccgaaaagcccgagtagcgccaaaagccgtctgcagaccgcacctgtgccgatgccggatctgaaaaatgttaaaagcaaaattggcagcaccgagaatctgaaacaccagcctggaggtggtaaagttcagattatcaacaaaaaactggatctgagcaatgtgcagagcaaatgtggtagcaaagacaacattaaacatgttccgggaggtggtagcgtgcagattgtttataaaccggttgatctgagtaaagtgaccagcaaatgcggcagcctgggtaatattcatcataaaccgggtggtggccaggttgaagttaaaagcgaaaaactggatttcaaagatcgcgttcagagcaaaattggtagcctggataacattacccatgtgcctggtggcggtaacaaaaaaattgaaacccacaaactgacctttcgcgaaaatgcaaaagccaaaaccgatcatggtgccgaaatcgtttataaaagtccggttgttagcggtgataccagtccgcgtcatctgagtaatgttagcagtaccggcagcattgatatggttgatagtccgcagctggcaaccctggcagatgaagttagcgcaagcctggcaaaacagggtctgtaagcggccgc

SEQ ID NO: 141 - DNA, 670 bp, Human
atagagagatactatgagaggtcgcatcccatcaccatcacggatcctatttaggtgacactatagaatcgtcgactctggaccttggctgtcactcagttggctgcggtaggaacatggcgggtcggctcacgcagcttcaggacgctgtgaattcgcttgcagatcagttttgtaatgccattggagtattgcagcaatgtggtcctcctgcctctttcaataatattcagacagcaattaacaaagaccagccagctaaccctacagaagagtatgcccagctttttgcagcactgattgcacgaacagcaaaagacattgatgttttgatagattccttacccagtgaagaatctacagctgctttacaggctgctagcttgtataagctagaagaagaaaaccatgaagctgctacatgtctggaggatgttgtttatcgaggagacatgcttctggagaagatacaaagcgcacttgctgatattgcacagtcacagctgaagacaagaagtggtacccatagccagtctcttccagactcatagcatcagtggataccatgtggctgagaaaagaactgtttgagtgccattaagaattctgcatcagacttagatacaagccttaccaacaattacagaaacattaaacactatgacacatg

SEQ ID NO: 142 - DNA, 874 bp, Human
  misc_feature (706)..(706): n is a, c, g, or t
  misc_feature (824)..(847): n is a, c, g, or t
agagagatactatgagaggtcgcatcaccatcaccatcacggatcctatttaggtgacactatagaatcgtcgactctggaccttggctgtcactcagttcttgaggaaaatagtgaacggactcagattcgccaaagcagggtctgtgctgacagagtaagtacttatgattgtggagaaaaaatttcaagctggttgtcaacattttttggccgtccttgtcatttgatcaaacaaagttcaaactctcaaaggaatgcaaagaagaaacatggaaaagatcaacttcctggtacaatggccaccctttctctggtgaatgaggcacagtatctgctgatcaacacatccagtattttggaacttcaccggcaactaaacaccagtgatgagaatggaaaggaggaattattctcactgaaggatctcagcttgcgttttcgtgccaatattattatcaatggaaaaagggcttttgaagaagagaaatgggatgagatttcaattggctctttgcgtttccaggttttggggccttgtcacagatgccagatgatttgcatcgaccagcaaactgggcaacgaaaccagcatgttttccaaaaactttctgagagtcgtgaaacaaaggtgaactttggcatgtacctgatgcatgcatcattggatttatcctccccatgtttcctgtctgtaggatctcangtgctccctgtgttgaaagagaatgtggaaggtcatgaattacctgcatctgagaaacaccaggatgttacctcctaaaaaaatttttagcatacattaaagtttctctttacagtgnnnnnnnnnnnnnnnnnnnnnnnnaaaaaacgagcggcgctccctatatga

SEQ ID NO: 143 - DNA, 279 bp, Human
atggctgtcttggctggatccctgttgggccccacgagtaggtcggcagcgttgctgggtggcaggtggctccagccccgggcctggctggggttcccagacgcctggggcctccccaccccgcagcaggcccggggcaaggctcgcgggaatgagtatcagccgagcaacatcaaacgcaagaacaagcacggctgggtccggcgcctgagcacgccggccggcgtgcaggtcatccttcgccgaatgctcaagggccgcaagtcgctgagccattga

SEQ ID NO: 144 - DNA, 1179 bp, Human
  misc_feature (1)..(1): n is a, c, g, or t
  misc_feature (878)..(878): n is a, c, g, or t
  misc_feature (901)..(901): n is a, c, g, or t
  misc_feature (949)..(949): n is a, c, g, or t
  misc_feature (984)..(984): n is a, c, g, or t
  misc_feature (991)..(991): n is a, c, g, or t
  misc_feature (996)..(996): n is a, c, g, or t
  misc_feature (1040)..(1040): n is a, c, g, or t
  misc_feature (1044)..(1044): n is a, c, g, or t
  misc_feature (1046)..(1046): n is a, c, g, or t
  misc_feature (1055)..(1055): n is a, c, g, or t
  misc_feature (1080)..(1080): n is a, c, g, or t
  misc_feature (1082)..(1082): n is a, c, g, or t
  misc_feature (1094)..(1094): n is a, c, g, or t
  misc_feature (1101)..(1101): n is a, c, g, or t
  misc_feature (1109)..(1110): n is a, c, g, or t
  misc_feature (1114)..(1114): n is a, c, g, or t
  misc_feature (1117)..(1118): n is a, c, g, or t
  misc_feature (1123)..(1123): n is a, c, g, or t
  misc_feature (1132)..(1132): n is a, c, g, or t
  misc_feature (1141)..(1141): n is a, c, g, or t
  misc_feature (1143)..(1143): n is a, c, g, or t
  misc_feature (1157)..(1157): n is a, c, g, or t
  misc_feature (1162)..(1162): n is a, c, g, or t
  misc_feature (1170)..(1170): n is a, c, g, or t
  misc_feature (1172)..(1172): n is a, c, g, or t
naattagagaaattactatgagaggatcgcatcaccatcaccatcacggatcctatttaggtgacactatagaatcgtcgacccacgcgtccgcgaagatggcggcggagcgacaggaggcgctgagggagttcgtggcggtgacgggcgccgaggaggaccgggcccgcttctttctcgagtcggccggctgggacttgcagatcgcgctagcgagcttttatgaggacggaggggatgaagacattgtgaccatttcgcaggcaacccccagttcagtgtccagaggcacagcccccagtgataatagagtgacatccttcagagacctcattcatgaccaagatgaagatgaggaggaagaggaaggccagaggagcaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcanaaactgggcagcactgccccccnaggtgttgagtaccagctctccagcccaacaggcagaaaatgaagccnaagccagctcttccatcttaatcgacgaatcaaancctaccnaaacntccaaattcggcttgcaaacggcgggaggctggtgcaaaatttnaccncngccccaggnatcagcgaaattccgactcttcttntngatgccggccanccatggntgccccanntttntcnncttantattttccnaaaaaaaantnggttataaaaaccnaaccntgaagaancnacctgtc

SEQ ID NO: 145 - DNA, 1162 bp, Human
  misc_feature (956)..(956): n is a, c, g, or t
  misc_feature (974)..(974): n is a, c, g, or t
  misc_feature (988)..(988): n is a, c, g, or t
  misc_feature (998)..(998): n is a, c, g, or t
  misc_feature (1008)..(1008): n is a, c, g, or t
  misc_feature (1016)..(1016): n is a, c, g, or t
  misc_feature (1021)..(1021): n is a, c, g, or t
  misc_feature (1036)..(1036): n is a, c, g, or t
  misc_feature (1039)..(1039): n is a, c, g, or t
  misc_feature (1058)..(1058): n is a, c, g, or t
  misc_feature (1067)..(1068): n is a, c, g, or t
  misc_feature (1084)..(1084): n is a, c, g, or t
  misc_feature (1086)..(1086): n is a, c, g, or t
  misc_feature (1089)..(1089): n is a, c, g, or t
  misc_feature (1112)..(1112): n is a, c, g, or t
  misc_feature (1117)..(1117): n is a, c, g, or t
  misc_feature (1126)..(1126): n is a, c, g, or t
  misc_feature (1133)..(1133): n is a, c, g, or t
  misc_feature (1139)..(1139): n is a, c, g, or t
  misc_feature (1144)..(1144): n is a, c, g, or t
  misc_feature (1152)..(1152): n is a, c, g, or t
  misc_feature (1154)..(1154): n is a, c, g, or t
  misc_feature (1159)..(1159): n is a, c, g, or t
agaaattaactatgagaggatcgcatcaccatcaccatcacggatcctatttaggtgacactatagaatcgtcgacccacgcgtccgctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaaaaaaacttggctgtcgaaacatttttctctctgactgctgctngaatgttcttggagctgnttcttatgtagggntttttttaangggatccctncattgaanataanggcttttccattaanaanaaatatttggacatgccanaatgttganntagtacccatctaatncnaangagttacataatcaaatttgaangaacnaagtcttcnccccaantttaanaaaanaacctttntnaaggnccc

SEQ ID NO: 146 - DNA, 871 bp, Human
agaattactatgagaggtcgcatcccatcaccatcacggatcctatttaggtgacactatagaatcgtcgactctggaccttggctgtcactcagtttaggacgaagaagaggaaagttgaagcaccagccgtgaccttaccatttctgtaattgaacatgatctgattttatagagcccacacccccagtctactccaggtggcaagatggacggagaagatggaatagaggccttaagattaaaccgtgctgagcaacatagagttgccctatccactgaaaaaaattgtattttgcaaaccctaagctctcctgattcagaaaaggaatcctccactaacgcaccaacaagagaacctggacaaacaccattactcagacgtaccgagggcacaggtgggtcagcatgttgccaccttgaaagaacatgataattctgtcaaagaagagacaacagcattattgacaaaagcccttacagaatagtgtggccgtaagacagctattcacagtagtgaatcatcttgcaacttgccatctactctgaatgacgatagtggactaaaggaagccacacctgctgtatggctcaacagtgttcctaccatggaacaagaagtttcaagtggctgcggacacactaccacgacccataatgtggctgcacatatcccaatctcagaaacagaagcctatccattgctgaaaaagccacccttcacgataatacaatcaaactgaaaacaggtcccaaagagctatgcttctggacaccttgtcggattgaatatgtcagcgggcattcaaaccaaaaactacaaaatgctcgaagcaattttctccaataagaagccatgcaggccagaaca

SEQ ID NO: 147 - skipped

SEQ ID NO: 148 - DNA, 945 bp, Human
  misc_feature (888)..(888): n is a, c, g, or t
  misc_feature (920)..(923): n is a, c, g, or t
  misc_feature (926)..(926): n is a, c, g, or t
  misc_feature (929)..(932): n is a, c, g, or t
  misc_feature (934)..(945): n is a, c, g, or t
tagagaaattactatgagaggatcgcatcaccatcaccatcacggatcctatttaggtgacactatagaatcgtcgacccacgcgtccgaaccgcagttgactagcacctgctaccgcgcctttgcttcctggcgcacgcggagcctcctggagcctgccaccatcctgcctactacgtgctgccctgcgcccgcagccatgtgccgcaccctggccgccttccccaccacctgcctggagagagccaaagagttcaagacacgtctggggatctttcttcacaaatcagagctgggctgcgatactgggagtactggcaagttcgagtggggcagtaaacacagcaaagagaatagaaacttctcagaagatgtgctggggtggagagagtcgttcgacctgctgctgagcagtaaaaatggagtggctgccttccacgctttcctgaagacagagttcagtgaggagaacctggagttctggctggcctgtgaggagttcaagaagatccgatcagctaccaagctggcctccagggcacaccagatctttgaggagttcatttgcagtgaggcccctaaagaggtcaacattgaccatgagacccgcgagctgacgaggatgaacctgcagactgccacagccacatgctttgatgcggctcaggggaagacacgtaccctgatggagaaggactcctacccacgcttcctgaagtcgcctgcttaccgggacctggctgcccaagcctcagccgcctctgccactctgtccagctgcagcctggacgagccctcacacacctgagtctccacggcagtgaggaagccagccgggaaagaaaggttgagtcacccatccccgaggtggctgcccctgtgtgggangcaggttctgcaaagcaagtgccagaggaccnnnnaanaannnnannnnnnnnnnnn

SEQ ID NO: 149 - DNA, 1295 bp, Human
  misc_feature (1)..(3): n is a, c, g, or t
  misc_feature (12)..(16): n is a, c, g, or t
  misc_feature (722)..(722): n is a, c, g, or t
  misc_feature (1111)..(1111): n is a, c, g, or t
  misc_feature (1116)..(1116): n is a, c, g, or t
  misc_feature (1163)..(1163): n is a, c, g, or t
  misc_feature (1191)..(1191): n is a, c, g, or t
  misc_feature (1204)..(1204): n is a, c, g, or t
  misc_feature (1209)..(1209): n is a, c, g, or t
  misc_feature (1245)..(1245): n is a, c, g, or t
  misc_feature (1259)..(1260): n is a, c, g, or t
nnncccattatnnnnnggatatattgacttacctataaataggcgtatccgaggccctttcgtcttcacctcgagaaatcataaaaaatttatttgctttgtgagcggataacaattataatagattcaattgtgagcggataacaatttcacacagaattcattaaagaggagaaattaactatgagaggatcgcatcaccatcaccatcacggtcgacccacgcgtccgagacaagctcagaagcgaactcgggaagcaacctccacccccgagatctccttggaagcagaacccatagaactcgtggaaactgctggagatgaaattgtggacctcacttgtgaatctttagagcctgtggtggttgatctgactcacaatgactctgttgtgattgttgacgaaagaagaagaccaaggaggaatgctaggaggctgccccaggaccatgctgacagctgtgtggtgagcagtgacgatgaggagttgtccagggacagagacgtatatgtgactacccatactcccagaaacgccagggatgagggcgctacaggcctcaggccctcaggtactgtcagttgtcccatctgcatggacggatactcagagatcgtgcagaatggacgtctcatcgtttccacagaatgcggccatgtcttctgtagccagtgcctccgtgattccctgaagaatgctaatacttgcccaacttgtangaaaaagatcaaccacaaacggtaccaccccatttatatatgaagtattcagaacccccccgggccgccgcgccgggcgcgatccgcatgcaacctcaataacctaaccttggaatcccggttgaaaaatcagtaaatgacctccaaaccccctctgggatttgatcaaaacgctcggttggccccccgggccgttttttattgagaaaaacccaccccacctgggcccaaatttcctgaacctaacgaaacaccaagggcgcaaacccccccgggataatccccccgcgagaaaacaccgaaggggcgccgaagaaaaaaatttcacggcattcaagcatatggccacgcctccctaaacgccaagacgccccaacttaaagaaaacncaccnatcacgagaccaaaagaaacaaaacccaatatgaagacccactgagntgacaaactagcctaccgcgtaagagantgacgcaattcgnactcnaactaacacgccctactccacgaaacaaaaactacnctccacatatcacnncaagaataagagtgtctaaacccaacccacgtacc

SEQ ID NO: 150 - DNA, 306 bp, Human
atggggtttgttaaagttgttaagaataaggcctactttaagagataccaagtgaaatttagaagacgacgagagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtctgcgcagcgtatgcacacgaactgccaaaatatggtgtgaaggttggcctgacaaattatgctgcagccaagtggaggtga

SEQ ID NO: 151 - DNA, 279 bp, Human
atgtctgagctggagaaggccatggtggccctcatcgacgttttccaccaatattctggaagggagggagacaagcacaagctgaagaaatccgaactcaaggagctcatcaacaatgagctttcccatttcttagaggaaatcaaagagcaggaggttgtggacaaagtcatggaaacactggacaatgatggagacggcgaatgtgacttccaggaattcatggcctttgttgccatggttactactgcctgccacgagttctttgaacatgagtga

SEQ ID NO: 152 - DNA, 1160 bp, Human
  misc_feature (1)..(1): n is a, c, g, or t
  misc_feature (884)..(884): n is a, c, g, or t
  misc_feature (899)..(899): n is a, c, g, or t
  misc_feature (931)..(931): n is a, c, g, or t
  misc_feature (934)..(934): n is a, c, g, or t
  misc_feature (955)..(955): n is a, c, g, or t
  misc_feature (984)..(984): n is a, c, g, or t
  misc_feature (987)..(987): n is a, c, g, or t
  misc_feature (991)..(991): n is a, c, g, or t
  misc_feature (1001)..(1001): n is a, c, g, or t
  misc_feature (1005)..(1005): n is a, c, g, or t
  misc_feature (1026)..(1026): n is a, c, g, or t
  misc_feature (1041)..(1041): n is a, c, g, or t
  misc_feature (1051)..(1051): n is a, c, g, or t
  misc_feature (1090)..(1090): n is a, c, g, or t
  misc_feature (1096)..(1096): n is a, c, g, or t
  misc_feature (1098)..(1098): n is a, c, g, or t
  misc_feature (1107)..(1108): n is a, c, g, or t
  misc_feature (1110)..(1110): n is a, c, g, or t
  misc_feature (1117)..(1117): n is a, c, g, or t
  misc_feature (1122)..(1122): n is a, c, g, or t
  misc_feature (1130)..(1130): n is a, c, g, or t
  misc_feature (1149)..(1149): n is a, c, g, or t
  misc_feature (1151)..(1151): n is a, c, g, or t
  misc_feature (1153)..(1155): n is a, c, g, or t
  misc_feature (1160)..(1160): n is a, c, g, or t
naatagagaaattactatgagaggatcgcatcaccatcaccatcacggatcctatttaggtgacactatagaatcgtcgacccacgcgtccgcttcgccttcccttctctccccctccccgctccccccccgaccgcggagcagcaccatgtcggcgccggcggccaaagtcagtaaaaaggagctcaactccaaccacgacggggccgacgagacctcagaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattanaagatattgacgaanaaggggatgaggatgaaggtgaagaagatganagnaatgatgaaggggaagaaagnaaaggaggatgaaggaaaaaatgactaantanaacnctgatggatnccanccttcctttttttaatttttnccagtccctggggancagttgcagnctttttttttttttttttttttttccccctggggcccancccccngntcttgaggnncntttcccnacccngggtcccnattttttgggggaaaaccntngnnnaaaan

SEQ ID NO: 153 - DNA, 468 bp, Human
  misc_feature (4)..(4): n is a, c, g, or t
  misc_feature (6)..(6): n is a, c, g, or t
  misc_feature (8)..(9): n is a, c, g, or t
  misc_feature (11)..(11): n is a, c, g, or t
  misc_feature (20)..(20): n is a, c, g, or t
  misc_feature (24)..(24): n is a, c, g, or t
  misc_feature (27)..(27): n is a, c, g, or t
  misc_feature (29)..(29): n is a, c, g, or t
  misc_feature (31)..(31): n is a, c, g, or t
  misc_feature (36)..(36): n is a, c, g, or t
  misc_feature (42)..(42): n is a, c, g, or t
  misc_feature (54)..(54): n is a, c, g, or t
  misc_feature (83)..(83): n is a, c, g, or t
  misc_feature (280)..(280): n is a, c, g, or t
  misc_feature (286)..(286): n is a, c, g, or t
  misc_feature (325)..(326): n is a, c, g, or t
  misc_feature (342)..(342): n is a, c, g, or t
  misc_feature (398)..(398): n is a, c, g, or t
  misc_feature (404)..(405): n is a, c, g, or t
  misc_feature (412)..(412): n is a, c, g, or t
  misc_feature (433)..(433): n is a, c, g, or t
  misc_feature (440)..(440): n is a, c, g, or t
  misc_feature (443)..(443): n is a, c, g, or t
  misc_feature (451)..(451): n is a, c, g, or t
  misc_feature (467)..(467): n is a, c, g, or t
aaanangnntnaaaaaaacnaatnctntngngcagnagtatnttaactatgagnaggatcgcatcaccatacaccatcacggnatcctatttaggtgacactatagaatcgtcgacccacgcgtccgctggagagaaaacttacacacagcgatgtcggttgtttgttgggaatctacctgctgatatcacggaggatgaattcaaaagactatttgctaaatatggagaaccaggagaagtttttatcaacaaaggcaaaggattcggatttattaagntttttntagagctttggctgaaattgccaaagccgaactgggtgnnacacccatgagaggcnccacagcttcgagttcgctttgccacacatgctgctgccctttctgttcgtaaaanaaaaanntatgttnccaatgaactgttggaagaancctttanccnatttggtnctattgaaagggctgnt

SEQ ID NO: 154 - DNA, 1156 bp, Human
  misc_feature (884)..(884): n is a, c, g, or t
  misc_feature (888)..(888): n is a, c, g, or t
  misc_feature (956)..(956): n is a, c, g, or t
  misc_feature (985)..(985): n is a, c, g, or t
  misc_feature (988)..(988): n is a, c, g, or t
  misc_feature (1011)..(1011): n is a, c, g, or t
  misc_feature (1017)..(1017): n is a, c, g, or t
  misc_feature (1020)..(1020): n is a, c, g, or t
  misc_feature (1022)..(1022): n is a, c, g, or t
  misc_feature (1028)..(1028): n is a, c, g, or t
  misc_feature (1030)..(1030): n is a, c, g, or t
  misc_feature (1032)..(1032): n is a, c, g, or t
  misc_feature (1045)..(1045): n is a, c, g, or t
  misc_feature (1054)..(1054): n is a, c, g, or t
  misc_feature (1063)..(1063): n is a, c, g, or t
  misc_feature (1071)..(1073): n is a, c, g, or t
  misc_feature (1091)..(1091): n is a, c, g, or t
  misc_feature (1095)..(1096): n is a, c, g, or t
  misc_feature (1099)..(1100): n is a, c, g, or t
  misc_feature (1103)..(1103): n is a, c, g, or t
  misc_feature (1113)..(1113): n is a, c, g, or t
  misc_feature (1120)..(1120): n is a, c, g, or t
tagagaaattactatgagaggatcgcatcaccatcaccatcacggatcctatttaggtgacactatagaatcgtcgacccacgcgtccgcaattgaataccttcaacccaatccagcttccagagctaagctcagcatgatcaacaccatgtcaaaaatccgtggccaggagaaggggccaggctatcctcaggcagaggcgctgctggcagaggccatgctcaaatttggaagagagcttggagatgattgcaactttggcccagcacttggtgaggtcggggaggccatgcgggaactgtcggaggtcaaagactctttggacatagaagtgaagcagaacttcattgaccctcttcagaatcttcatgacaaagatcttagggaaattcaacatcatctaaagaagttggagggtcgacgcctggattttgattataagaagaaacgacaaggcaagattccggatgaagagcttcgtcaagctctagagaaatttgatgagtctaaggaaattgctgagtcaagcatgttcaatctcttggagatggatattgaacaagtgagccagctctctgcacttgtgcaagctcagctggagtaccacaagcaggcagtccagatcctgcagcaagtcacggtcagactggaagaaagaataagacaggcttcatctcagcctagaagggaatatcaacctaaaccacgaatgagcctggagtttccaactggagacagtactcagcccaatgggggtctctcccacacaggcactcccaaaccttcaggtgtccaaatggatcagccctgctgccgagctctgtacgactttgaacctgaaaatgaaggggagttggggatttaaagagggcgatatcatcacnctcnctaaccaattgatgaaaactggtatgaggggatgctgcatggccattcaggcttcttccccatcaatnatgtggaaattctggttgccccggccccnatnaggatgttatgctggctggctcncccccnctngnacccanananttacggttaaccncctgctttnggcaaggcngcttttannncatcccaagggcaggccngcannggnnccncgttcctccnacccccnccaagggaatttgggttgaactttgggggccccccc

SEQ ID NO: 155 - DNA, 818 bp, Human
  misc_feature (1)..(1): n is a, c, g, or t
  misc_feature (9)..(13): n is a, c, g, or t
  misc_feature (685)..(685): n is a, c, g, or t
  misc_feature (784)..(784): n is a, c, g, or t
  misc_feature (789)..(789): n is a, c, g, or t
  misc_feature (796)..(796): n is a, c, g, or t
  misc_feature (798)..(798): n is a, c, g, or t
  misc_feature (802)..(802): n is a, c, g, or t
  misc_feature (809)..(810): n is a, c, g, or t
  misc_feature (816)..(816): n is a, c, g, or t
  misc_feature (818)..(818): n is a, c, g, or t
ngccaatgnnnnnggatatactgacttacctataaataggcgtatcacgaggccctttcgtcttcacctcgagaaatcataaaaaatttatttgctttgtgagcggataacaattataatagattcaattgtgagcggataacaatttcacacagaattcattaaagaggagaaattaactatgagaggatcgcatcaccatcaccatcacggtcgacccacgcgtccgggggaggactctgattcagacagtgaggaagaggacgatgaggaagaggatgatgaagatgaagacgacgatgatgatgaggaggatggtgatgaggtgcctgtacccagctttggggaggccatggcttactttgccatggtcaagaggtacctgacctccttccccattgatgaccgcgtgcagagccacatcctccacttggaacacgatctggttcatgtgaccaggaagaaccacgccaggcaggcgggagttcgaggtcttggacatcaaagctgagtcactggacctagctgtgcccccaacctagattggcagcaccaccccagggcagaggactctctgggcacccgctgtgcatggagccagagtgcagagccccagatcctttagtaatgcttcccctggtcctgcaacaggcccggtcacctcggccgggcccggggctgaggncagcctccctgcctgcttattgcctctttctccgaatcctctttcctccccatttggccctgggctccgggggaccagtggggcgggtggggaacctgnccggngctaccncnccgngccctcnngggacnan

SEQ ID NO: 156 - DNA, 497 bp, Human
  misc_feature (373)..(373): n is a, c, g, or t
  misc_feature (379)..(380): n is a, c, g, or t
  misc_feature (382)..(382): n is a, c, g, or t
  misc_feature (385)..(385): n is a, c, g, or t
  misc_feature (391)..(391): n is a, c, g, or t
  misc_feature (404)..(404): n is a, c, g, or t
  misc_feature (406)..(407): n is a, c, g, or t
  misc_feature (414)..(414): n is a, c, g, or t
  misc_feature (416)..(416): n is a, c, g, or t
  misc_feature (438)..(438): n is a, c, g, or t
  misc_feature (440)..(440): n is a, c, g, or t
  misc_feature (455)..(455): n is a, c, g, or t
  misc_feature (460)..(460): n is a, c, g, or t
  misc_feature (463)..(463): n is a, c, g, or t
  misc_feature (466)..(466): n is a, c, g, or t
  misc_feature (469)..(469): n is a, c, g, or t
  misc_feature (477)..(477): n is a, c, g, or t
  misc_feature (487)..(487): n is a, c, g, or t
  misc_feature (489)..(489): n is a, c, g, or t
taagaggagaattaactatgagaggatcgcatcaccatcaccatcacggatcctatttaggtgacactatagaatcgtcgacccacgcgtccgagatcctggaggagatcaagcaggagcggaggctgcgcccggtgcggggcgagggctgggctgcccgcgggtttggctctctgccctgcatcctcaacgcctgctccggagatgccaagtccacctcctgcatcaacctgtcagtcacagatgctgggggcagcgcccagcgcccgcggccccgcgtgctgctcaaggcgcctaccttggctgaaatggaagagatgaatacatctgaggaagaagagtctccgtgtggggaggtgacgctgaaaagggnaccgcnncnttntcaaanaatgacctggccnanntccgaangngggggccttttggcctgaaatngncccccaccccccggnggganggnccnccncgcccccnaattggaaangncatttggg

SEQ ID NO: 157 - DNA, 843 bp, Human
  misc_feature (15)..(16): n is a, c, g, or t
  misc_feature (19)..(19): n is a, c, g, or t
  misc_feature (704)..(704): n is a, c, g, or t
  misc_feature (718)..(718): n is a, c, g, or t
  misc_feature (729)..(729): n is a, c, g, or t
  misc_feature (751)..(751): n is a, c, g, or t
  misc_feature (755)..(755): n is a, c, g, or t
  misc_feature (758)..(758): n is a, c, g, or t
  misc_feature (770)..(770): n is a, c, g, or t
  misc_feature (814)..(814): n is a, c, g, or t
  misc_feature (816)..(816): n is a, c, g, or t
ttattaaagaggagnnatnacttgagaggatcgcataccatcaccatcacggatcctatttaggtgacactatagaatcgtcgacccacgcgtccgatggcaaagacctggcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaactggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatganaaaatgaccctggnggccagcgaanattatggcgacactcttgccgncatncanggcttactgaanaaacatgaagcttttgagacagacttcaccgtcccaaggatcgngngaatgatgtctgcaccatggacaagac

SEQ ID NO: 158 - DNA, 1415 bp, Human
catatactgactacctataaataggcgtatccgaggccctttcgtcttcacctcgagaaatcataaaaaatttatttgctttgtgagcggataacaattataatagattcaattgtgagcggataacaatttcccacagaattcattaaagaggagaaattaactatgagaggatcgcatcaccatcaccatcacggtcgacccacgcgtccgcggaagtacaaagaaacagacctgctaatacttttcaaggacgattactttgccaaaaaaaatgaagaaagaaaacaaaataaagtggaagctaaattaagagctaaacaggagcaagaagcaaaacaaaagttagaagaagatgctgaaatgaaatctctacaagaaaagattggatgcttgctgaaattttcgggtgatttagatgatcagacctgtagagaagatttacacatacttttctcaaatcatggtgaaataaaatggatagacttcgtcagaggagcaaaagaggggataattctatttaaagaaaaagccaaggaagcattgggtaaagccaaagatgcaaataatggtaacctacaattaaggaaccaagaactgacttgggaagtactagaaggagaggtggaaaaagaagccctgaagaaaataatacaagacccacaagaatccctacacaaatggaagtcaaaacgtccgaaatttaaacggaaaaggaagggtaataaagcttgccccccctgggtctggtaaaggaaaagtacagtttcagggcaaaaaacgcaatttgctagcgatcatgaacatgaccaacatgatgaaaaagggtgcaactggaccctgggaaaacagcagaagaaaaacccgccaccgaaataccccgcctccccacccaccgaaaacccaaacagggcgcctgggagacccctaatttcaccaaccccctttttctatctccttttaaaaacggcttagaccaacccttggctaccgcgggctttcaaacggcaaaccccactcagggccccctccatgggcccgccgggccgaaagcggaaactctctctcggcggcccacctcgtcctctctcctagccccaagcaagaaccctcatagacgcactcgcacccggctgggcgacaacccgccaccacatctgcgcaactcacaagccccggcgtgggggccccccgccagaccaaccagaacccgcccccacgaccccgacgcagccgtgttcgaaccacagccgcggccctcagatcgctttactccccacgcaaacccgacaagcactacgaaaactatcctagcaacctcgagatgctcacagccgaaatacatatggaccgctacacgcgccacaggtgaccgtacgacagagcacagaaccgtctaccctctcaccgcgctg

SEQ ID NO: 159 - DNA, 862 bp, Human
agagatactatgagaggtcgcatcccatcaccatcacggatcctatttaggtgacactatagaatcgtcgactctggaccttggctgtcactcagttgaagagagaaaggttgtgatggcggctatagctgcatccgaggtgctggtggacagcgcggaggaggggtccctcgctgcggcggcggagctggccgctcagaagcgcgaacagagactgcgcaaattccgggagctgcacctgatgcggaatgaagctcgtaaattaaatcaccaggaagttgtggaagaagataaaagactaaaattacctgcaaattgggaagccaaaaaagctcgtttggagtgggaactaaaggaagaggaaaagaaaaaggaatgtgcggcaagaggagaagactatgagaaagtgaagttgctggagatcagtgcagaagatgcagaaagatgggagaggaaaaagaagaggaaaaaccctgatctgggattttcagattatgctgctgcccagttacgccagtatcatcggttgaccaagcagatcaaacctgacatggaaacatatgagagactgagagaaaaacatggagaagagtttttcccaacatccaatagtcttcttcatggaacacatgtgccttccacagaggaaattgacaggatggtcatagatctggaaaaacagattgaaaaacgagacaaatatagccggagacgtccttataatgatgatgcagatatcgactacatttaatgaaggaatgcccaattcaacagaaagctgaaagatctatgggaatacacagctgaaattaacagaatttgggaagagacagctgtctaatccctcaagactgtttataga

SEQ ID NO: 160 - DNA, 839 bp, Human
  misc_feature (6)..(6): n is a, c, g, or t
  misc_feature (725)..(725): n is a, c, g, or t
  misc_feature (833)..(833): n is a, c, g, or t
ccccgntgtatagagagatactagagaggatgcatcaccatcaccatcacggatcctatttaggtgacactatagaatcgtcgactctggaccttggctgtcactcagttgaggcgcccgaagccgtcgcggcggggaccatgttgcttccgaacatcctgctcaccggtacaccaggggttggaaaaaccacactaggcaaagaacttgcgtcaaaatcaggactgaaatacattaatgtgggtgatttagctcgagaagagcaattgtatgatggctatgatgaagagtatgactgtcccattttagatgaagacagagtagttgatgagttagataaccaaatgagagaaggtggagttattgttgattaccatggttgtgatttcttccctgaacgctggtttcatatagtttttgtgctgagaacagataccaatgtattgtacgaaagacttgaaacaaggggttataatgagaagaaactaacagacaatattcagtgtgagatttttcaagttctttatgaagaagccacagcatcctacaaggaagaaatcgtgcatcagctgcccagtaataaaccagaagagctagaaaataatgtagatcagatcttgaaatgaattgagcagtggatcaaagatcataactcttgacttataaggctagctacttaataatcactcttgttgatatctctgccgacatcatagaaattgttncagtgtcagtaacactttattaagatcatgttgcagaaccagcaggtggatagtatataggtttatgcctgtgtttcttttctccatgagaaaagctaactgaaatantatgaa

SEQ ID NO: 161 - DNA, 864 bp, Human
  misc_feature (676)..(676): n is a, c, g, or t
  misc_feature (696)..(697): n is a, c, g, or t
  misc_feature (708)..(708): n is a, c, g, or t
cacatcaccatcacggatcctatttaggtgacactatagaatcgtcgactctggaccttggctgtcactcagttatgtttgaaatccccagtcctgacttcagttttcatgctgatgagtacctagaagtctacgtttctgcttctgagcaccctaaccacttctggatccagatcgttggctcccgcagcctgcaattggataagcttgtcaatgagatgacccagcactatgagaatagtgtgcctgaagacttgactgtgcatgtaggagacattgtagcagcacctttacctacaaatggttcctggtatcgagcccgggtcctcggcaccttggagaatgggaacttggacctctattttgttgactttggagataatggagattgcccactgaaggacctcagggctctcaggagtgacttcctaagccttccatttcaagcaatagaatgtagtctggcacggattgctccctcaggtgaccagtgggaagaggaagctttggatgagtttgatagactcactcattgtgctgactggaagcctctggtagccaagatctctagctatgtccagactgggatctcaacttggccaaagatctacttatatgatactagcaatgggaagaaacttgatattgggctagaattagtacacaaaggatacgncattgagcttccctgagacnntagagaaaacngagctgtcccagacatgttgaaggacatggccacagaaacagatgcctctctcagcacgttgctcactgagaccaaaagagctctggagagataaccataccctgccctggctcactatcagagctgcttccatgttgggggatgatacctgaaat

SEQ ID NO: 162 - DNA, 1241 bp, Human
  misc_feature (930)..(930): n is a, c, g, or t
  misc_feature (1007)..(1007): n is a, c, g, or t
  misc_feature (1038)..(1038): n is a, c, g, or t
  misc_feature (1040)..(1040): n is a, c, g, or t
  misc_feature (1043)..(1043): n is a, c, g, or t
  misc_feature (1050)..(1050): n is a, c, g, or t
  misc_feature (1067)..(1067): n is a, c, g, or t
  misc_feature (1095)..(1095): n is a, c, g, or t
  misc_feature (1097)..(1097): n is a, c, g, or t
  misc_feature (1107)..(1107): n is a, c, g, or t
  misc_feature (1126)..(1126): n is a, c, g, or t
  misc_feature (1150)..(1150): n is a, c, g, or t
  misc_feature (1160)..(1160): n is a, c, g, or t
  misc_feature (1166)..(1166): n is a, c, g, or t
  misc_feature (1168)..(1168): n is a, c, g, or t
  misc_feature (1171)..(1171): n is a, c, g, or t
  misc_feature (1173)..(1174): n is a, c, g, or t
  misc_feature (1178)..(1179): n is a, c, g, or t
  misc_feature (1185)..(1185): n is a, c, g, or t
  misc_feature (1188)..(1191): n is a, c, g, or t
  misc_feature (1193)..(1194): n is a, c, g, or t
  misc_feature (1200)..(1200): n is a, c, g, or t
  misc_feature (1210)..(1210): n is a, c, g, or t
  misc_feature (1215)..(1215): n is a, c, g, or t
  misc_feature (1219)..(1219): n is a, c, g, or t
  misc_feature (1223)..(1223): n is a, c, g, or t
  misc_feature (1234)..(1234): n is a, c, g, or t
  misc_feature (1236)..(1236): n is a, c, g, or t
tagaggaaattactatgagaggatcgcatcaccatcaccatcacggatcctatttaggtgacactatagaatcgtcgacccacgcgtccgcccacgcgtccgcggacgcgtgggttcatgactgcagtgcctcatttgaggaggagccaggagcggacaaggttgagaacaaatctaatgaagatgtgaattcctctgaactagatgaagaatacctaatagaactggaaaaaaacatgtcggatgaagagaaacagaaaagaagagaagagagcactagactaaaggaggagggaaatgaacagtttaagaaaggagattatatagaagctgaaagttcttatagtcgagccctcgaaatgtgcccatcctgcttccaaaaggagaggtcgattctattttcaaatagagctgcagcaaggatgaaacaggacaagaaagaaatggccatcaatgactgcagcaaagcaattcaattaaaccccagctatatcagggcaatattgaggagagcagagttgtatgagaagacggacaagctagatgaagccctggaagactataaatctatattagaaaaagatccatcaatacatcaagcaagagaagcttgtatgagattacctaagcaaattgaagaacgtaatgaaagactaaaagaagagatgttaggtaaattaaaagatcttgggaacttggttctccgaccttttgggctctccacggaaaatttccagatcaaacaggattcctctaccggctcgtactccatcaatttcgttcaaaatccaaataataacagataacaaagataacaaaagctttacaagctgacttggaattgtgtgctgcttgctgttagctaggggaaaggccctgccaatgtttaacttttaaagcatcttatctaaaagaaaggctatccagtanagcccagtgctcccttgtccctcttttatgatcagggtgaaatgtacttcctgatgtatgaacctaatttgattccnttttaaggggggtctgtgcactgggtccccnantcngctgtcnttgtccggaaaaacccnttttttgaggctgacttcctgatctacncnccccgcccancaaagcccctctgaccaanaacctgttggtgggaacctgcccnaaatgatgangacggntnccncnngtgnncccccntannnnanntaaaangtgccccccntttcngatncccngggaaaaaacntntggtt

SEQ ID NO: 163 - DNA, 3013 bp, Human
atggaacagtctccgcctccggcaccggaaccgacacagggtccgacaccggcacgtagccgtcgtcgtcgtgaaccggaaagccctccggcaagcgcaccgattccgctgtttggtgcagataccattggtcagcgttctccggatggtccggttctgagcaaagccgaatttgttgaaaaagttcgtcagagcaatcaggcatgtcatgatggtgattttcataccgccatcgttctgtataatgaagcactggcagttgatccgcagaattgcattctgtatagcaatcgtagcgcagcctatatgaaaatccagcagtatgataaagcactggatgatgcaattaaagcacgtctgctgaatccgaaatggccgaaagcatattttcgtcagggtgttgcactgcagtatctgggtcgtcatgcagatgcactggcagcatttgcaagcggtctggcacaggacccgaaaagcctgcagctgctggttggtatggttgaagcagcaatgaaaagcccgatgcgtgatagcctggaaccgacctatcagcagctgcagaaaatgaaactggataaaagcccgtttgttgttgttagcgttgttggtcaggaactgctgaccgcaggtcatcatggtgcaagcgttgttgttctggaagcagccctgaaaattggcacctgtagcctgaaactgcgtggtagcgtttttagcgcactgagcagcgcatattggagcctgggtaataccgaaaaaagcaccggttatatgcagcaggatctggatgttgcaaaaaccctgggtgatcagaccggtgaatgtcgtgcacatggtaatctgggtagcgcattttttagcaaaggtaactatcgtgaagcactgaccaatcatcgtcatcagctggttctggcaatgaaactgaaagatcgtgaagcagcaagcagcgcactgtctagcctgggtcatgtttataccgcaattggtgattatccgaatgcactggcaagccataaacagtgtgttctgctggcaaaacagagcaaagatgaactgagcgaagcacgtgaactgggtaatatgggtgcagtttatattgccatgggcgattttgaaaatgcagttcagtgtcatgaacagcatctgaaaattgccaaagatctgggcaataaacgtgaagaagcacgcgcatatagcaatctgggttctgcatatcattatcgtcgcaactttgataaagccatgagctatcacaattatgttctggaactggcacaagaactgatggaaaaagcaatcgaaatgcgtgcatatgcaggtctgggtcatgcagcacgttgtatgcaggacctggaacgtgcaaaacagtatcacgaacagcagctgggtattgcagaagatctgaaagatcgcgcagccgaaggtcgtgcaagcagcaatctgggcattattcatcagatgaaaggcgattatgataccgcactgaaactgcataaaacccatctgtgtattgcacaggaactgagcgattacgcagcacagggtcgtgcatatggcaatatgggcaatgcatataatgcactgggtatgtatgatcaggccgtgaaatatcatcgtcaagaactgcagattagcatggaagttaatgatcgtgcaagccaggcaagcacccatggcaatctggcagttgcatatcaggccctgggtgcacatgatcgtgcactgcagcattatcagaatcatctgaacattgcccgtgaactgcgtgatattcagagcgaagcccgtgcactgtctaatctgggtaattttcattgcagccgtggtgaatatgttcaggcagcaccgtattatgaacagtatctgcgtctggcaccggatctgcaggatatggaaggtgaaggtaaagtttgccataatctgggttatgcacattattgcctgggtaattatcaggaagccgtcaaatattacgaacaggatctggcactggcaaaagatctgcatgataaactgagccaggccaaagcatattgtaatctgggtctggcatttaaagcactgctgaactttagcaaagcagaagagtgtcagaaatatctgctgagcctggcacagagcctgaataatagccaggcaaaatttcgtgcactgggcaatctgggtgacatcttcatttgcaaaaaagatatcaacggtgccatcaaattttatgaacaacagctgggactggcccatcaggttaaagatcgtcgtctggaagcaagcgcatatgcagcactgggcaccgcatatcgtatgatccagaaatatgacaaagctctgggttatcatacccaggaactggaagtttatcaggaactgtctgatctgcctggtgaatgccgtgcccacggccatctggcagcagtttatatggcactgggtaaatataccatggcctttaaatgctatgaggaacagctggatctgggtcaaaaactgaaagacccaagtctggaagcacaggtttatggtaacatgggcattaccaaaatgaacatgaacgtgatggaagaagccattggttattttgagcagcagctggcaatgctgcagcagctgagcggtaatgaaagcgttctggatcgtggtcgtgcgtatggtaacctgggtgattgttatgaagccctgggtgattatgaagaggccattaaatattatgagcagtacctgagcgttgcacagtctctgaatcgtatgcaggatcaggcaaaagcatatcgtggtctgggtaatggtcatcgtgcaatgggtagcctgcaacaggcactggtttgttttgaaaaacgtctggttgttgcacatgaactgggtgaagcatttaataaagcccaggcatatggtgaactgggttctctgcatagccagctgggcaattatgaacaggcaattagctgtctggaacgtcagctgaatattgcgcgtgatatgaaagaccgtgcactggaaagcgactaagcggccgcttaattaa

SEQ ID NO: 164 - DNA, 1232 bp, Human
  misc_feature (1)..(1): n is a, c, g, or t
  misc_feature (776)..(776): n is a, c, g, or t
  misc_feature (800)..(800): n is a, c, g, or t
  misc_feature (812)..(812): n is a, c, g, or t
  misc_feature (834)..(834): n is a, c, g, or t
  misc_feature (856)..(856): n is a, c, g, or t
  misc_feature (872)..(872): n is a, c, g, or t
  misc_feature (884)..(884): n is a, c, g, or t
  misc_feature (903)..(903): n is a, c, g, or t
  misc_feature (939)..(939): n is a, c, g, or t
  misc_feature (958)..(958): n is a, c, g, or t
  misc_feature (960)..(960): n is a, c, g, or t
  misc_feature (967)..(967): n is a, c, g, or t
  misc_feature (980)..(980): n is a, c, g, or t
  misc_feature (982)..(982): n is a, c, g, or t
  misc_feature (994)..(994): n is a, c, g, or t
  misc_feature (1002)..(1003): n is a, c, g, or t
  misc_feature (1010)..(1010): n is a, c, g, or t
  misc_feature (1027)..(1027): n is a, c, g, or t
  misc_feature (1033)..(1033): n is a, c, g, or t
  misc_feature (1041)..(1041): n is a, c, g, or t
  misc_feature (1044)..(1044): n is a, c, g, or t
  misc_feature (1051)..(1051): n is a, c, g, or t
  misc_feature (1056)..(1056): n is a, c, g, or t
  misc_feature (1060)..(1060): n is a, c, g, or t
  misc_feature (1063)..(1063): n is a, c, g, or t
  misc_feature (1075)..(1075): n is a, c, g, or t
  misc_feature (1080)..(1080): n is a, c, g, or t
  misc_feature (1087)..(1087): n is a, c, g, or t
  misc_feature (1089)..(1090): n is a, c, g, or t
  misc_feature (1094)..(1094): n is a, c, g, or t
  misc_feature (1102)..(1102): n is a, c, g, or t
  misc_feature (1105)..(1105): n is a, c, g, or t
  misc_feature (1112)..(1112): n is a, c, g, or t
  misc_feature (1120)..(1120): n is a, c, g, or t
  misc_feature (1146)..(1146): n is a, c, g, or t
  misc_feature (1159)..(1159): n is a, c, g, or t
  misc_feature (1167)..(1167): n is a, c, g, or t
  misc_feature (1170)..(1170): n is a, c, g, or t
  misc_feature (1174)..(1175): n is a, c, g, or t
  misc_feature (1178)..(1178): n is a, c, g, or t
  misc_feature (1184)..(1184): n is a, c, g, or t
  misc_feature (1187)..(1187): n is a, c, g, or t
  misc_feature (1197)..(1197): n is a, c, g, or t
  misc_feature (1209)..(1209): n is a, c, g, or t
  misc_feature (1212)..(1212): n is a, c, g, or t
  misc_feature (1216)..(1216): n is a, c, g, or t
  misc_feature (1232)..(1232): n is a, c, g, or t
natagagaaattactatgagaggatcgcatcaccatcaccatcacggatcctatttaggtgacactatagaatcgtcgacccacgcgtccgcggcaccgcccgggaagctgcgcgagggtcgacagcctccgccacatcctccacctctcttggtccagcgagcgttgccgggccagggtcaagcggagggctccgacggcgcggacggagcgaagcgccgagccatggcgcaccaaacgggcatccacgccacggaagagctgaaggaattctttgccaaggcacgggctggctctgtgcggctcatcaaggttgtgattgaggacgagcagctcgtgctgggtgcctcgcaggagccagtaggccgctgggatcaggactatgacagggccgtgctgccactgctggacgcccagcagccctgctacctgctctaccgcctcgactcacagaatgctcagggcttcgaatggctcttcctcgcctggtcgcctgataactcccccgtgcggctgaagatgctgtacgcggccacgcgggccacagtgaaaaaggagtttggaggtggccacatcaaggatgagctcttcgggactgtgaaggatgacctctcttttgctgggtaccagaaacacctgtcgtcctgtgcggcacctgccccgctgacctcggctgagagagagctccagcagatccgcattaacgaggtgaagacagagatcagtgtggaaagcaagcaccagaccctgcagggccctcgccttcccccctgcancctgaggcccagcgggcactccancagctcaagcanaaaatggtcaactacatccaanatgaagctggaactagagcggnaaaccattgagcttgntgcacacagaancccacggatgtggccccanctgcccctcccgggttgccccgaaatgcctgccccnctaaccactttctttcctntnaaaagcnaaaccatgaaggncnaccccctttgantctgtaanngtttcanctactccatgcccgggntaaaanttgcaacnatncaagaancgaangctntanttcaacttcaanaaccnccctccntnnaatncgtggaanaanaatttcnttggaaantcccaaaaaaaatttaaatttcaatngggcaaaaatttnaagaaaanttntttnnaanaagtgnccncaaaaaaacncctttttaaaangcntttnccaacccaaaggccan

SEQ ID NO: 165 - DNA, 895 bp, Human
  misc_feature (826)..(826): n is a, c, g, or t
  misc_feature (835)..(835): n is a, c, g, or t
  misc_feature (842)..(842): n is a, c, g, or t
  misc_feature (882)..(882): n is a, c, g, or t
atagggagatactatgagaggatgcatcaccatcaccatcacggatcctatttaggtgacactatagaatcgtcgactctggaccttggctgtcactcagttagtagcatgaacaccgcgaacagcctctgtctgggtgggacccccgcgagtgcatccagcagcagtagcagggccgcgcccttggtgacctcaggcaaagcacccccaaacttacctcagggggtgcctcccctgctgcacaaccagtacctcgtaggtcccggaggactgcttcctgcctacccgatctatggctatgacgagctccagatgctgcagtcacggctgccagtggactactatggaattccctttgctgcacccacagcgcttgccagccgagatgggagcctagctaataatccatatccaggtgatgtcacaaagtttggccgtggggactctgcatcccctgcacccgctaccacaccagctcagccacagcagagccaatcacagacccaccacacagcccagcagcccttcgtgaatcctgcactgccacctggctatagctacactggtcttccctactacacaggcatgcccagtgccttccagtatggccccaccatgtttgtccctccagcctcagccaagcaacatggggtgaacctcagcactcccacacctcccttccagcaggccagtggttatggccagcacggctacagtacaggttatgacgacctgacccaggggacagcagcaggagactactccaaaggtggctatgctggatcatcgcaggcaccaaccagtctgcaggttctgggctggcaangagtatcantgtcttnagcacaactgtctacttgaatgactggtctgtctacatanaaacgactttgac

SEQ ID NO: 166 - DNA, 851 bp, Human
  misc_feature (767)..(767): n is a, c, g, or t
  misc_feature (797)..(797): n is a, c, g, or t
  misc_feature (809)..(809): n is a, c, g, or t
  misc_feature (830)..(830): n is a, c, g, or t
  misc_feature (845)..(845): n is a, c, g, or t
agactatgagaggtcgcatcccatcaccatcacggatcctatttaggtgacactatagaatcgtcgactctggaccttggctgtcactcagttaaccagctactcaaaagcttcgacttccactttggcttctgcatccccagcagcaagaacacctgcgagcacatttacgacttcccccctctctccgaggagctgatcagcgagatgatccgccacccgtatgagacccagtctgacagcttctacttcgtggatgaccggctggtgatgcacaataaagcagactattcctacagcgggacaccctgaccccacggctgccctgaccccaggaggctccagttctgggctgggagctgtgacctccccaacgctcacccctcaaccccaagtcctctgcttggggagttctccaggagctccggaccctgagtcaatgttgggaggaagggtacctggtgtccccagtcaagcccatgaagcccatgcggcctgctacatggggtggggtcgtagggaggctgtttgcctccacgtctaggaaggcctgtgagaggagcagtcaggacttccggacaacttagctgggccctacttgggcccaagtttcagaatagtgttcccctatcaaggctgtgactagatcaggcagggatccattccctgtcccctgcccactaccttcaggccatttagagttgtaaatttacaaagatccacggtgggctccagctgccaagccacccagggagtctggggcctangcctagccccatcctccccatgaggggccnagacactgctangtgtgggagggactggctganatgcacccatggtangagctg

SEQ ID NO: 167 - DNA, 1182 bp, Human
  misc_feature (714)..(714): n is a, c, g, or t
  misc_feature (717)..(717): n is a, c, g, or t
  misc_feature (855)..(855): n is a, c, g, or t
  misc_feature (886)..(886): n is a, c, g, or t
  misc_feature (903)..(903): n is a, c, g, or t
  misc_feature (913)..(913): n is a, c, g, or t
  misc_feature (916)..(916): n is a, c, g, or t
  misc_feature (937)..(937): n is a, c, g, or t
  misc_feature (941)..(941): n is a, c, g, or t
  misc_feature (954)..(954): n is a, c, g, or t
  misc_feature (968)..(968): n is a, c, g, or t
  misc_feature (1002)..(1002): n is a, c, g, or t
  misc_feature (1008)..(1008): n is a, c, g, or t
  misc_feature (1018)..(1018): n is a, c, g, or t
  misc_feature (1045)..(1045): n is a, c, g, or t
  misc_feature (1047)..(1047): n is a, c, g, or t
  misc_feature (1051)..(1051): n is a, c, g, or t
  misc_feature (1053)..(1053): n is a, c, g, or t
  misc_feature (1065)..(1065): n is a, c, g, or t
  misc_feature (1069)..(1069): n is a, c, g, or t
  misc_feature (1072)..(1073): n is a, c, g, or t
  misc_feature (1077)..(1077): n is a, c, g, or t
  misc_feature (1083)..(1083): n is a, c, g, or t
  misc_feature (1090)..(1090): n is a, c, g, or t
  misc_feature (1092)..(1092): n is a, c, g, or t
  misc_feature (1098)..(1098): n is a, c, g, or t
  misc_feature (1123)..(1123): n is a, c, g, or t
  misc_feature (1130)..(1130): n is a, c, g, or t
  misc_feature (1137)..(1139): n is a, c, g, or t
  misc_feature (1148)..(1148): n is a, c, g, or t
  misc_feature (1153)..(1153): n is a, c, g, or t
  misc_feature (1159)..(1159): n is a, c, g, or t
  misc_feature (1167)..(1168): n is a, c, g, or t
  misc_feature (1170)..(1170): n is a, c, g, or t
attagagaaattactatgagaggatcgcatcaccatcaccatcacggatcctatttaggtgacactatagaatcgtcgacccacgcgtccgggagaaacaaaagcaccgtccacccacaagggctgggggaacggaggcgcccttggagcgaagaggaggaggaggaggaggaagaggaggatgtagtgctgacctccgagatggatttttcccctgaaaatggggtcttttcacccctagccacccccagcctcatcccgcaggcggccctggagctgaagcaggcattccgagaggccctgcaggcagtagaggccacccaggggcagcagcagcagctccgagggatggtacccattgtgctcgtggcgaagctggggccgcaggtcatggcggcagccagggtgcccccaaggttgcagcccgaggagctggggctggcaggcgcccaccccctggacttcctgctcctggacgcgccgctgggcggcccgctggggctggacacactcctggatggggatccggccatggcactgaagcacgaggagcggaaatgcccctactgccccgatcgcttccacaacggcatcggcttggccaaccacgtccggggccacctgaaccgcgtgggcgtcagctacaatgtgcgccatttcatctccgctgaggaggtgaaggccattgagcgcaggttctccttccagaagaanaanaaaaagtggccaactttgacccaggcaccttcagcctgatgcgctgtgacttctgcggggctggcttcgacacacggggccggcctctccagccacgcccgggcccacctacgtgacttcggtatcaccaactggganctcactgtctcacccatcaacattcctgcangaactgctggccacctntgctgctgancanccccccagcccccctgggccnaaancctgggggttccncctgggaaactttncttgaacctcccgttgggccccgcttaacttctnaagggngccttttccncccaccctgggctgaagaaacctgggncnaccntntggaaaatgccnaaanccnnaacncctttngaaggtntntcggtncctttttttaaaaacccaaaagggnttgtttnaaccaannngggtttccnctttngggaanttggaaanngnaaaatttgaaaa

SEQ ID NO: 168 - DNA, 705 bp, Human
cccaatagagagatactatgagaggatgcatcaccatcaccatcacggatcctatttaggtgacactatagaatcgtcgactctggaccttggctgtcactcagttagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttcctcgactattacactgcctggaggatagcagagaagcctgtctgtacttcattcaaaaagccaaaatagagagtatacagtcctagag

SEQ ID NO: 169 - DNA, 1191 bp, Human
  misc_feature (845)..(845): n is a, c, g, or t
  misc_feature (850)..(850): n is a, c, g, or t
  misc_feature (853)..(853): n is a, c, g, or t
  misc_feature (862)..(862): n is a, c, g, or t
  misc_feature (864)..(864): n is a, c, g, or t
  misc_feature (877)..(877): n is a, c, g, or t
  misc_feature (892)..(892): n is a, c, g, or t
  misc_feature (906)..(906): n is a, c, g, or t
  misc_feature (912)..(912): n is a, c, g, or t
  misc_feature (926)..(926): n is a, c, g, or t
  misc_feature (935)..(935): n is a, c, g, or t
  misc_feature (949)..(949): n is a, c, g, or t
  misc_feature (951)..(951): n is a, c, g, or t
  misc_feature (975)..(975): n is a, c, g, or t
  misc_feature (977)..(977): n is a, c, g, or t
  misc_feature (980)..(980): n is a, c, g, or t
  misc_feature (984)..(984): n is a, c, g, or t
  misc_feature (986)..(986): n is a, c, g, or t
  misc_feature (988)..(988): n is a, c, g, or t
  misc_feature (992)..(992): n is a, c, g, or t
  misc_feature (998)..(998): n is a, c, g, or t
  misc_feature (1010)..(1010): n is a, c, g, or t
  misc_feature (1012)..(1012): n is a, c, g, or t
  misc_feature (1014)..(1014): n is a, c, g, or t
  misc_feature (1017)..(1017): n is a, c, g, or t
  misc_feature (1019)..(1019): n is a, c, g, or t
  misc_feature (1023)..(1024): n is a, c, g, or t
  misc_feature (1032)..(1032): n is a, c, g, or t
  misc_feature (1063)..(1063): n is a, c, g, or t
  misc_feature (1091)..(1091): n is a, c, g, or t
  misc_feature (1104)..(1105): n is a, c, g, or t
  misc_feature (1112)..(1112): n is a, c, g, or t
  misc_feature (1116)..(1116): n is a, c, g, or t
  misc_feature (1126)..(1126): n is a, c, g, or t
  misc_feature (1130)..(1130): n is a, c, g, or t
  misc_feature (1138)..(1138): n is a, c, g, or t
  misc_feature (1159)..(1159): n is a, c, g, or t
  misc_feature (1181)..(1181): n is a, c, g, or t
  misc_feature (1188)..(1188): n is a, c, g, or t
agagaaattactatgagaggatcgcatcaccatcaccatcacggatcctatttaggtgacactatagaatcgtcgacccacgcgtccgacgatattttgaaaccaccgggccgggagagcagacctgagagaattgttgttataatgagaggattacctggcagtggaaagacacatgttgcaaaacttattcgagataaggaggtagaatttggaggacctgcacccagagttctaagcctggatgattacttcatcactgaagtggaaaaagaagaaaaagatccagattctggaaagaaagtgaaaaagaaggtaatggaatatgaatatgaagctgagatggaggagacttaccgcaccagcatgttcaaaactttcaaaaagactctggatgatggcttttttcccttcatcatcctggatgccatcaatgacagagttaggcattttgaccagttttggagtgcagcaaaaaccaagggatttgaggtatatttggctgaaatgagtgcagataaccagacttgtggcaagagaaatattcatggaagaaagcttaaagaaataaataaggtagagatggaagattttgatgcaaatatcgaagaacagaaagaagaaaagaaagatgcagaggaagaggaaagcgaactgggttacattccgaaaagcaaatgggagatggacacatctgaggcaaagctagacaagttggatggcttgaggactggtactaaaaggaaacgtgactgggaggccattgccagcagaatggaggattatcttcagctccccgatgattatgatactcgtgcttctgagcctgggaagaaaagggtcanatggncanacctggaananaagaaggatgcanataggaaaagggccntaggttttgttggncggacnagactgattggganaaaatcccnagatgaaagggggncncctggctgaaaaagccccccatcnanccnaatntntntganacttantttttgaccggngncnttntncccnnaaaggggntcccctttgagggggtctgaaaccaaggccnccccggaaccttctttgggggccccctngctccccgtttcnnttcttgntttnttcccccggnttantttttttnaaaggtccccccgggcccccnaaaaggtttaaaatcttgttgncccaaanaaa

SEQ ID NO: 170 - DNA, 350 bp, Human
catcaccatcaccatcacggatcctatttaggtgacactatagaatcgtcgacccacgcgtccgcagcgactcggggacctggagctgacgcctagacacttgtattagctttaatagaagagaaatggaggagccatagaatattaaggatgaattcaggaaggcctgagaccatggaaaacttgcctgctctctacactattttccaaggagaggttgctatggtgacagactatggggcctttatcaaaatcccaggctgtcggaagcaaggtctggtccatcgaactcatatgtcatcctgtcgggtggataagccctctgagatagtagatgttggagataaagt

SEQ ID NO: 171 - DNA, 872 bp, Human
  misc_feature (1)..(2): n is a, c, g, or t
  misc_feature (789)..(789): n is a, c, g, or t
nnaaaatagagagaatactatgagaggatcgcatcaccatcaccatcacggatcctatttaggtgacactatagaatcgtcgactctggaccttggctgtcactcagttgaactcggctgctctgggggattcgtgcgcggtaccactgatgaaattatgaccaggtgggcccgagttagtaccacatataacaagagacccttgcctgcaacatcatgggaggacatgaagaagggatcctttgagggaacaagccaaaacctaccaaagcgtaaacaacttgaagccaataggctatccctcaaaaatgatgcaccccaagcaaaacataaaaagaacaaaaagaaaaaagagtacttaaatgaagatgtgaatggattcatggaatacctaagacagaattcacagatggttcacaatgggcaaattatagcaacagacagtgaggaagtaagggaagaaattgcagttgctttaaagaaagacagtcgacgggaaggaagaagattaaaaagacaagcggcaaagaaaaatgcaatggtgtgtttccattgtagaaaacctggtcatggaattgcagattgccccgccgcccttgaaaatcaagacatgggcactgggatatgttacaggtgtgggtccacagagcacgaaataaccaagtgtaaggctaaagtagacccggctcttggcgaatttccttttgcaaaatgttttgtttgtggagaaatggggcacctgtctagatcttgtcctgataatccaaaggactctatgctgatggtggncggtgcaaacttgtggctctgtgaacatttaaagaagatgccctgaagtcagaatcagagcgaatgtccagtggtcgctggca

SEQ ID NO: 172 - DNA, 444 bp, Human
atgccggaagttagcagcaaaggtgcaaccattagcaaaaaaggtttcaaaaaagccgtggtgaaaacccagaaaaaagaaggcaaaaaacgtaaacgtacccgcaaagaaagctacagcatctatatctacaaagtgctgaaacaggttcatccggataccggcattagcagtaaagcaatgagcattatgaatagcttcgtgaccgatatctttgaacgtattgcaagcgaagcaagccgtctggcacattatagcaaacgtagcaccattagtagccgtgaaattcagaccgcagttcgtctgctgctgcctggtgaactggcaaaacatgcagttagcgaaggcaccaaagcagttaccaaatataccagcagcaaaagatcttaagcggccgcggtacctggagcacaagactggcctcatgggccttccgctcactgc

SEQ ID NO: 173 - DNA, 1267 bp, Human
  misc_feature (926)..(926): n is a, c, g, or t
  misc_feature (936)..(936): n is a, c, g, or t
  misc_feature (943)..(943): n is a, c, g, or t
  misc_feature (951)..(951): n is a, c, g, or t
  misc_feature (967)..(967): n is a, c, g, or t
  misc_feature (987)..(987): n is a, c, g, or t
  misc_feature (991)..(992): n is a, c, g, or t
  misc_feature (994)..(994): n is a, c, g, or t
  misc_feature (1011)..(1011): n is a, c, g, or t
  misc_feature (1027)..(1027): n is a, c, g, or t
  misc_feature (1032)..(1032): n is a, c, g, or t
  misc_feature (1041)..(1041): n is a, c, g, or t
  misc_feature (1045)..(1046): n is a, c, g, or t
  misc_feature (1052)..(1052): n is a, c, g, or t
  misc_feature (1058)..(1058): n is a, c, g, or t
  misc_feature (1072)..(1072): n is a, c, g, or t
  misc_feature (1082)..(1082): n is a, c, g, or t
  misc_feature (1089)..(1089): n is a, c, g, or t
  misc_feature (1097)..(1097): n is a, c, g, or t
  misc_feature (1113)..(1113): n is a, c, g, or t
  misc_feature (1115)..(1115): n is a, c, g, or t
  misc_feature (1149)..(1149): n is a, c, g, or t
  misc_feature (1157)..(1157): n is a, c, g, or t
  misc_feature (1159)..(1160): n is a, c, g, or t
  misc_feature (1170)..(1170): n is a, c, g, or t
  misc_feature (1183)..(1184): n is a, c, g, or t
  misc_feature (1187)..(1187): n is a, c, g, or t
  misc_feature (1196)..(1197): n is a, c, g, or t
  misc_feature (1210)..(1210): n is a, c, g, or t
  misc_feature (1215)..(1216): n is a, c, g, or t
  misc_feature (1222)..(1222): n is a, c, g, or t
  misc_feature (1231)..(1231): n is a, c, g, or t
  misc_feature (1237)..(1238): n is a, c, g, or t
  misc_feature (1240)..(1240): n is a, c, g, or t
  misc_feature (1243)..(1243): n is a, c, g, or t
  misc_feature (1248)..(1248): n is a, c, g, or t
  misc_feature (1252)..(1252): n is a, c, g, or t
  misc_feature (1257)..(1257): n is a, c, g, or t
  misc_feature (1261)..(1261): n is a, c, g, or t
  misc_feature (1267)..(1267): n is a, c, g, or t
tagagagaattactatgaagaggatcgcatcaccatcaccatcacggatcctatttaggtgacactatagaatcgtcgacccacgcgtccgggcccgggctcattcattccgcgccgggcctgccagacacctgcgcccttctgcagccgcccgccgcatccgccgccgcagcccccagcatgtcgggcccagacgtcgagacgccgtccgccatccagatctgccggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaagttcgccgggatcgtggctgcacgccactgcaagaccaacatcgtcacagcttccgtggaacgccatttaattttcatgacaaagatcaaaaaaaggctgcgtnattcaccatntcgggangcatgacnttcacgaacaaataanttccatgaaatatcaagttnttgnngnaaccccaaccttgttgnggaaactttcaaaaanccctnccggggccnccanngctttnttcacntaagtgttcttaanccaaaaaggnaggtccnttcctgtncccccatgttcaatcncnttaaaaattccccctttggccaaaacccattttnatttaaancnngggttttttnaaatttttctaannaangttaacctnnatttttttgtaancctannaccaantttttttanttcttnncntanaagtnaacnggttncccnaacccn

SEQ ID NO: 174 - DNA, 1337 bp, Human
  misc_feature (16)..(23): n is a, c, g, or t
  misc_feature (595)..(595): n is a, c, g, or t
  misc_feature (597)..(598): n is a, c, g, or t
ccccctcacatttccnnnnnnnngcgcccctctccttgcaatactatgaagatgcatcaccatcaccatcacggtcgacccacgcgtccggggcagggccggcgcggcccggccatggagtcctacgacatcatcgccaaccagcctgtggtcatcgacaacggttcgggggtgattaaagctggctttgcaggagaccagattcccaaatactgtttcccaaactatgtcgggcggccgaagcacatgcgggtgatggctggagccctggagggggacctcttcatcggaccaaaagcagaggagcaccgggggctgctgaccatccgctaccccatggagcacggcgtggtgcgagactggaacgacatggaacgcatctggcagtacgtctactccaaggatcagctgcagaccttctcggaggagcatcctgtgctcctcacggaggccccgctcaacccgagtaagaaccgggagaaggcggcagaggtgttctttgagaccttcaacgtgccggccctgttcatctccatgcaggctgtgctcagtctgtacgcaacaggacgcacgacaggagtggttctagactcangnngacgggtcactcatgctgtgcccatctatgagggctttgccatgcctcactccatcatgcgggtggacattgccggccgcgacgtctcccgctacctccgactcctgctgcgcaaggaaggggttgacctcataactcggctgaatttgaagttgcccggaacatcaaaaagggacggggttactgtcccatcaccccccaaagaataaggccctggaaaagaaaaagggcgaatacccgtgcccaaaggaaaacgccttgatgggggccctggccaatcccaggcccccaatctgtttttccccccgaccctttgggggagaaaaaaaacggccccccaagaggggggccctccaccaaaaaaaactcaaatggacccctcccgaatccttttccccacacagcgccccacgggggcacaacctctaaggagtccggaacccaatctccccagacgtcacaacttcccccccaagaacccaacacctaaccccccccccccaaaacgcttcctcccaccaaaatgacgcctccctccctcccccccggaacaattcacaaaagcgaggccccaaccagcacccaaagatcgccctcccaccacccctcaaaatcaatactcacccccaccactccactctcataaaccaactagttcatccaccccccctccctcatcagccctacgatataccacctactcgccacctcacccgagcaaactccactcctcttcaac

SEQ ID NO: 175 - DNA, 915 bp, Human
ctatgagaggtcgcatcaccatcaccatcacggatcctatttaggtgacactatagaatcgtcgacccacgcgtccgctctctcgtccggtgtctgcgtgccaagctgtattaccaactgcttgtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaaggagacggatgcgctagagagtacctgttaccctaaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgta

SEQ ID NO: 176 - DNA, 1107 bp, Human
  misc_feature (923)..(923): n is a, c, g, or t
  misc_feature (926)..(926): n is a, c, g, or t
  misc_feature (946)..(946): n is a, c, g, or t
  misc_feature (958)..(958): n is a, c, g, or t
  misc_feature (977)..(977): n is a, c, g, or t
  misc_feature (991)..(991): n is a, c, g, or t
  misc_feature (1001)..(1001): n is a, c, g, or t
  misc_feature (1011)..(1011): n is a, c, g, or t
  misc_feature (1023)..(1024): n is a, c, g, or t
  misc_feature (1040)..(1040): n is a, c, g, or t
  misc_feature (1045)..(1046): n is a, c, g, or t
  misc_feature (1055)..(1055): n is a, c, g, or t
  misc_feature (1057)..(1057): n is a, c, g, or t
  misc_feature (1072)..(1072): n is a, c, g, or t
  misc_feature (1074)..(1074): n is a, c, g, or t
  misc_feature (1077)..(1077): n is a, c, g, or t
  misc_feature (1080)..(1080): n is a, c, g, or t
  misc_feature (1085)..(1085): n is a, c, g, or t
  misc_feature (1090)..(1090): n is a, c, g, or t
  misc_feature (1092)..(1092): n is a, c, g, or t
  misc_feature (1097)..(1097): n is a, c, g, or t
tagagaaattactatgagaggatcgcatcaccatcaccatcacggatcctatttaggtgacactatagaatcgtcgacccacgcgtccggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcattgaagtanccnaactatccacattcatgaanactgaagccccncagtggaattggcaacccnctgcaccccctganagaggtcaantgggtaagancattttttatcnncaaactttcctgggtngatgnnatgatcagncnttggaaatttcactntnagnaantctangtccnanggaanaatcgatctc

SEQ ID NO: 177 - DNA, 904 bp, Human
catcaccatcaccatcacggatcctatttaggtgacactatagaatcgtcgacccacgcgtccgagctgaagaaaaccaagatcatctttgtggtgggtgggcctggctcagggaagggcacccagtgtgagaagatcgtgcagaagtatggctacacccacctctccaccggggacctcctgcggtccgaggtcagctcaggctcggccaggggcaagaagctgtcggaaatcatggagaaggggcagctggttccactggagacagtgttggacatgctccgggatgccatggtggccaaagtcaatacttccaaaggcttcctgattgatggctacccgcgggaggtgcagcaaggagaagagtttgagcgacggattggacagcccacactgctgctgtatgtggacgcaggccctgagaccatgacccagcggctcttgaaacgtggagagaccagcgggcgtgtggacgacaatgaggagaccatcaaaaagcggctggagacctattacaaggccacagaacccgtcatcgccttctatgagaaacgtggcattgtgcgcaaggtcaacgctgagggctccgtggacagtgtcttctcccaggtctgcacccacctggacgccctaaagtagcaacgctggagccgcttccccagctcagagccccgccccaccccgtcctgattcgaggtcctcctggcctgagcgcagcgcctccaccctgccctgctgagcacagacggaggaagccgcttatcctgttttcatggacagctgagcactaaaggaatttctaaggacatttggttttactgctttttctctgcttccagttggagttgattcatgtgcttgtgcctacctggccgcaagtccccagcccctcaaccctccgttc

SEQ ID NO: 178 - DNA, 1313 bp, Human
  misc_feature (1)..(3): n is a, c, g, or t
  misc_feature (602)..(602): n is a, c, g, or t
nnnggatatattgacttacctataaataggcgtatcacgaggccctttcgtcttcacctcgagaaatcataaaaaatttatttgctttgtgagcggataacaattataatagattcaattgtgagcggataacaatttcacacagaattcattaaagaggagaaattaactatgagaggatcgcatcaccatcaccatcacggtcgacccacgcgtccgggggaagaagataaggggaagagcagctcatcccaggtggtggggccagtgcaggaggaagagtatgtagcagagaagttgccaagtaggttcatcgagtcggctcacacagagctggcaaaggacgatgcggcgccagcacccccagtcgcagacgccaaagcccaggatagaggtgtcgagggagaactgggcaatgaggagagcttggatagaaatgaggagggcttggatagaaatgaggagggcttggatagaaatgaggagagcttggatagaaatgaggagggcttggatagaaatgaggagattaagcgggctgccttccagataatctcccaagtgatctcagaagcaaccgaacaggtgctggccaccacggntggcaaggttgcaggtcgtgtgtgtcaggccagtcagctccaagggcagaaggaagagagctgtgtccccagtcaccaaaaaaatgtcttgggcccaaacactgcggaacctgccacagcaaaagcagctggtgcccccccggaagctggcctccccttgccgggcctaccagcaaaggggccacccccacaaaaaacctaccggaacggcccgaaaaaccctctgtccaccccccccaggaaagaaagccaaaaattccgccaacccaaattccccggaccccctgcccgggaactgacccccccccgggaaaaaaatccccaaaacggccaaccacccctggggaaaaacgcccccccgggacacacatcagggaccaccacagcgaaaaaagcacccgctgcgggggcctacacagcccggcgaccccagtatctcaccagcgataccgccaggaagaacacctgtacgcaaaatcgagtccgcaccgcaccccgcgacaccaggccccacaacacaaaccgcacacgccccagggcgccagctaaccaccgtaatcgacccgccccactcaaccacacgcgtcagctaccccgacagccccgcaacccgcacagcaggtaccgtcccggacgcgaagaaggacgacaaggcacaggagacacaaagcacaccccgcacacaggcgcccctgcagcaaaacgccacgc

SEQ ID NO: 179 - DNA, 1281 bp, Human
caagctatactgaattacctataaataggcgtatcacgaggccctttcgtcttcacctcgagaaatcataaaaaatttatttgctttgtgagcggataacaattataatagattcaattgtgagcggataacaatttcacacagaattcattaaagaggagaaattaactatgagaggatcgcatcaccatcaccatcacggtcgacccacgcgtccgcccacgcgtccgcccacgcgtccggtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggcccagccccagcaccgcgtgaccatgaacgagtttgagtacctgaagctgctgggcaagggccctttcggcaaggtgatcctggtgaaagaaaaagccacaaggccgctataaccccaggaaaaacccccacaaaggaagtcaccgtggcccaaggaccaagggggaccatatactccaccgaaaaaccccgtcccgcaaaaattcaagacacccccttctctcacaacacccgaagagcctcttttcatcacactcaaaaccaccccggcacttaccaatggagcaaaacccacgcgaggaacagacatgatcaacacaacggagcccccagcaagaatgcacctcgccacaagtacgaccaacatatgtaatgagagagcatacctcaggcacaccacaaaccaaccgtcccacgcaaaccccaaccagaacatgacacctccacctgctaacaccggcacataaacttgacctaacacatagacccctcactcgcactatccatcgccccataacgcacacgagccacgatacgccaacaatcaggccgagcgtgctagaacttccagccaactcgaacaacatggacaaatac

SEQ ID NO: 180 - DNA, 596 bp, Human
  misc_feature (1)..(1): n is a, c, g, or t
nggctcttttcccttaagaatactagagaggatgcatcaccatcccatcacggtcgacccacgcgtccggatagactcttggtccagctgcctttgtctttagtatataacagtgaagattctgcagaatatcagttcactgggacttattctacaaggctagatgaacagtgtagtgctattcccacccgtaccatgcatttcgagaagcactggagattactggaaagtatgaaagcacagtatgttgctgggaatggttttcgaaaagtgtcctgtgtgttaagctcaaatcttcgtcatgtgagagtatttgaaatggacatagatgatgaatgggagctcgatgagtcttcagatgaagaggaggaggccagtaataagcctgtaaaaataaaggaagaagtgttgtcggagtcagaggcagagaaccaacaagctggtgctgccgctttagctccagagatagtcattaaagtggaaaaacttgaccctgagctagactcctaatctagcttgccattattgtgtgcgtaattatggccaaaaggacataggagatggactaagatgtcttggaccacctttgtgtaaca

SEQ ID NO: 181 - DNA, 912 bp, Human
  misc_feature (2)..(2): n is a, c, g, or t
  misc_feature (346)..(346): n is a, c, g, or t
  misc_feature (366)..(366): n is a, c, g, or t
  misc_feature (455)..(455): n is a, c, g, or t
  misc_feature (484)..(484): n is a, c, g, or t
  misc_feature (490)..(490): n is a, c, g, or t
  misc_feature (495)..(495): n is a, c, g, or t
  misc_feature (504)..(504): n is a, c, g, or t
  misc_feature (537)..(537): n is a, c, g, or t
  misc_feature (637)..(637): n is a, c, g, or t
  misc_feature (666)..(666): n is a, c, g, or t
  misc_feature (678)..(678): n is a, c, g, or t
  misc_feature (698)..(698): n is a, c, g, or t
  misc_feature (721)..(721): n is a, c, g, or t
  misc_feature (730)..(730): n is a, c, g, or t
  misc_feature (740)..(740): n is a, c, g, or t
  misc_feature (748)..(748): n is a, c, g, or t
  misc_feature (755)..(755): n is a, c, g, or t
  misc_feature (781)..(781): n is a, c, g, or t
  misc_feature (790)..(790): n is a, c, g, or t
  misc_feature (792)..(792): n is a, c, g, or t
  misc_feature (794)..(794): n is a, c, g, or t
  misc_feature (799)..(799): n is a, c, g, or t
  misc_feature (803)..(803): n is a, c, g, or t
  misc_feature (821)..(822): n is a, c, g, or t
  misc_feature (846)..(846): n is a, c, g, or t
  misc_feature (848)..(848): n is a, c, g, or t
  misc_feature (855)..(855): n is a, c, g, or t
  misc_feature (858)..(858): n is a, c, g, or t
  misc_feature (862)..(863): n is a, c, g, or t
  misc_feature (868)..(868): n is a, c, g, or t
  misc_feature (872)..(872): n is a, c, g, or t
  misc_feature (878)..(879): n is a, c, g, or t
  misc_feature (881)..(881): n is a, c, g, or t
  misc_feature (890)..(890): n is a, c, g, or t
  misc_feature (899)..(899): n is a, c, g, or t
  misc_feature (905)..(905): n is a, c, g, or t
  misc_feature (907)..(907): n is a, c, g, or t
antagagaaattactatgagaggatcgcatcaccatcaccatcacggatcctatttaggtgacactatagaatcgtcgacccacgcgtccgcccacgcgtccggaaagtcccactcgccctcggcttctccctgcccggccgccggtgtcccgcccgccgcctccccgcgcagcccggcccgacccgcggcgatggcccagcccggggacccgcggcgcctctgcaggctggtgcaggagggccggctgcgcgccctgaaggaggagctgcaggcggccgggggctgcccggggccggccggggataccctcctgcactgcgccgcgcgccacgggcatcgggacntgctggcctatctggccgangcctggggcatggacatcgaggtcaccaaccgagactacaagcggcctctgcacgaggcggcctccatgggccaccgagactgcgtgcnctacctgctgggccggggggcagcggtcnactgcntgaanaaggccgantggactcctctgatgatggcctgcacaaggaanaacctgggggtgatccaggagctggtggaacatggcgccaatccactcctgaagaacaaagatggctggaacagtttccacattgccagtcgagaaggcnaccctctgatcctccaagtacctgctcantgtttgcccagngtgccctggaatacagagancaaaattagaaggactcctctgnatactgcancaatgcatgnaccatttngaggcantcaaagtgcttctttaagaggtgccnatatgaacnanantacanaaanaattgttggcgtcaccgnnttgatggaactcaattcaattttntncacatcnaantctnntaagnctgntccttnnantaaaaatgnggctttgcntttcananaaaaa

SEQ ID NO: 182 - DNA, 1064 bp, Human
  misc_feature (1)..(1): n is a, c, g, or t
  misc_feature (4)..(4): n is a, c, g, or t
  misc_feature (740)..(740): n is a, c, g, or t
  misc_feature (797)..(797): n is a, c, g, or t
  misc_feature (823)..(823): n is a, c, g, or t
  misc_feature (829)..(829): n is a, c, g, or t
  misc_feature (838)..(838): n is a, c, g, or t
  misc_feature (874)..(874): n is a, c, g, or t
  misc_feature (885)..(886): n is a, c, g, or t
  misc_feature (889)..(889): n is a, c, g, or t
  misc_feature (902)..(902): n is a, c, g, or t
  misc_feature (908)..(908): n is a, c, g, or t
  misc_feature (933)..(933): n is a, c, g, or t
  misc_feature (937)..(937): n is a, c, g, or t
  misc_feature (943)..(944): n is a, c, g, or t
  misc_feature (959)..(959): n is a, c, g, or t
  misc_feature (963)..(963): n is a, c, g, or t
  misc_feature (973)..(973): n is a, c, g, or t
  misc_feature (980)..(980): n is a, c, g, or t
  misc_feature (989)..(989): n is a, c, g, or t
  misc_feature (1006)..(1006): n is a, c, g, or t
  misc_feature (1008)..(1008): n is a, c, g, or t
  misc_feature (1013)..(1013): n is a, c, g, or t
  misc_feature (1017)..(1017): n is a, c, g, or t
  misc_feature (1019)..(1019): n is a, c, g, or t
  misc_feature (1025)..(1025): n is a, c, g, or t
  misc_feature (1028)..(1028): n is a, c, g, or t
  misc_feature (1035)..(1036): n is a, c, g, or t
  misc_feature (1046)..(1046): n is a, c, g, or t
  misc_feature (1051)..(1051): n is a, c, g, or t
  misc_feature (1056)..(1056): n is a, c, g, or t
  misc_feature (1060)..(1060): n is a, c, g, or t
  misc_feature (1063)..(1064): n is a, c, g, or t
natngagaaattactatgagaggatcgcatcaccatcaccatcacggatcctatttaggtgacactatagaatcgtcgacccacgcgtccgcccaggacaagacaagccgctctgcactccctgatgcggcccctgtgaccaaagacagtggtcctgggagcacaagaggagaaaaggaagacacgttattgacaaccatgcttcgaaacggagctcccctcaccagactcccgagtgacaagctgaaagcagtcatccccccattcctacccccttccagttttgagctgtggagctctgatcggtcccggacgcgtcacaacgggaaggcagaccccatgaagactgcgctgccccagagagccagcaggggccaccccgtgggcggcgggggcacagacactacacccgtcaggcctgttaaatttccaagcctccccagaagcccagcctcttctgccaattctggaaacttcaaccactcgcctcattcatcgggcggctccagtgggataggtgtgagccggcacggtggggagctgcttaaccgctcaggtggcagcatagacaatgtcttgtcccaaatcgctgcccagaggaaaaaagcagccggattattggagcagaaacccagccatcggtcaagccctgtggggccagcaccggggtccagcccgtctgagcttccagcctcccctgcaggtggcagcgctcctgttggcaagaaattggagaccancaaaaggcctccatctggaacttccactacctccaagagcacctctccaaccctcangccctcccccttcaccaaagggcacnctgcanagtcctcantgtcttcctcgtcatcccatcggcagtcaaaaacantgggggctccnncantggcaccatccanaatgangatgaactgactggaattccttaanaaanttatcnnttgaaaaaatatcancccnattttttgangaacaanaaggtgganatggaaacgtttcttcnanctganttgnanggtganttnaaagganntgggaaattnaaaanaaaangggntcnn

SEQ ID NO: 183 - DNA, 2844 bp, Human
atgccttatgccaaattagaatacaagagatcttcaaatgatagtttaaatagtgtcagtagtagtgatggttatggtaaaagaggtcaaatgaaaccctcgattgaatcctattctgaagatgatgaaagtaagttttgcagttatggtcaatacccagccgacctagcccataaaatacatagtgcaaatcatatggatgataatgatggagaactagatacaccaataaattatagtcttaaatattcagatgagcagttgaactctggaaggcaaagtccttcacagaatgaaagatgggcaagacccaaacacataatagaagatgaaataaaacaaagtgagcaaagacaatcaaggaatcaaagtacaacttatcctgtttatactgagagcactgatgataaacacctcaagttccaaccacattttggacagcaggaatgtgtttctccatacaggtcacggggagccaatggttcagaaacaaatcgagtgggttctaatcatggaattaatcaaaatgtaagccagtctttgtgtcaagaagatgactatgaagatgataagcctaccaattatagtgaacgttactctgaagaagaacagcatgaagaagaagagagaccaacaaattatagcataaaatataatgaagagaaacgtcatgtggatcagcctattgattatagtttaaaatatgccacagatattccttcatcacagaaacagtcattttcattctcaaagagttcatctggacaaagcagtaaaaccgaacatatgtcttcaagcagtgagaatacgtccacaccttcatctaatgccaagaggcagaatcagctccatccaagttctgcacagagtagaagtggtcagcctcaaaaggctgccacttgcaaagtttcttctattaaccaagaaacaatacagacttattgtgtagaagatactccaatatgtttttcaagatgtagttcattatcatctttgtcatcagctgaagatgaaataggatgtaatcagacgacacaggaagcagattctgctaataccctgcaaatagcagaaataaaagaaaagattggaactaggtcagctgaagatcctgtgagcgaagttccagcagtgtcacagcaccctagaaccaaatccagcagactgcagggttctagtttatcttcagaatcagccaggcacaaagctgttgaattttcttcaggagcgaaatctccctccaaaagtggtgctcagacacccaaaagtccacctgaacactatgttcaggagaccccactcatgtttagcagatgtacttctgtcagttcacttgatagttttgagagtcgttcgattgccagctccgttcagagtgaaccatgcagtggaatggtaagtggcattataagccccagtgatcttccagatagccctggacaaaccatgccaccaagcagaagtaaaacacctccaccacctcctcaaacagctcaaaccaagcgagaagtacctaaaaataaagcacctactgctgaaaagagagagagtggacctaagcaagctgcagtaaatgctgcagttcagagggtccaggttcttccagatgctgatactttattacattttgccacggaaagtactccagatggattttcttgttcatccagcctgagtgctctgagcctcgatgagccatttatacagaaagatgtggaattaagaataatgcctccagttcaggaaaatgacaatgggaatgaaacagaatcagagcagcctaaagaatcaaatgaaaaccaagagaaagaggcagaaaaaactattgattctgaaaaggacctattagatgattcagatgatgatgatattgaaatactagaagaatgtattatttctgccatgccaacaaagtcatcacgtaaagcaaaaaagccagcccagactgcttcaaaattacctccacctgtggcaaggaaaccaagtcagctgcctgtgtacaaacttctaccatcacaaaacaggttgcaaccccaaaagcatgttagttttacaccgggggatgatatgccacgggtgtattgtgttgaagggacacctataaacttttccacagctacatctctaagtgatctaacaatcgaatcccctccaaatgagttagctgctggagaaggagttagaggaggggcacagtcaggtgaatttgaaaaacgagataccattcctacagaaggcagaagtacagatgaggctcaaggaggaaaaacctcatctgtaaccatacctgaattggatgacaataaagcagaggaaggtgatattcttgcagaatgcattaattctgctatgcccaaagggaaaagtcacaagcctttccgtgtgaaaaagataatggaccaggtccagcaagcatctgcgtcttcttctgcacccaacaaaaatcagttagatggtaagaaaaagaaaccaacttcaccagtaaaacctataccacaaaatactgaatataggacacgtgtaagaaaaaatgcagactcaaaaaataatttaaatgctgagagagttttctcagacaacaaagattcaaagaaacagaatttgaaaaataattccaaggtcttcaatgataagctcccaaataatgaagatagagtcagaggaagttttgcttttgattcacctcatcattacacgcctattgaaggaactccttactgtttttcacgaaatgattctttgagttctctagattttgatgatgatgatgttgacctttccagggaaaaggctgaattaagaaaggcaaaagaaaataaggaatcagaggctaaagttaccagc

SEQ ID NO: 184 - DNA, 865 bp, Human
  misc_feature (646)..(646): n is a, c, g, or t
  misc_feature (760)..(760): n is a, c, g, or t
  misc_feature (778)..(778): n is a, c, g, or t
  misc_feature (819)..(819): n is a, c, g, or t
  misc_feature (826)..(827): n is a, c, g, or t
  misc_feature (847)..(848): n is a, c, g, or t
gagagatactatgagaggtcgcatcaccatcaccatcacggatcctatttaggtgacactatagaatcgtcgactctggaccttggctgtcactcagttgaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaagtgaacagggatattgtgtcaggcctgaaatacgttcagcacacctacaggactggggtgaaagtggataaagcaacatttatggttggcagctatggacctcggcctgaggagtatgagttcctcactccagttgaggaggctcccaagggcatgctggcccgaggcacgtaccacaacaagtccttcttcaccgacgatgacaagcaagaccacctcagctgggagtggaacctgtcgattaagaaggagtggacagaatgaatgcatccacccctttccccacccttgccacctggaagaattctctcangcgtgttcagcaccctgtccctcctccctgtccacagctgggtccctcttcaacactgccacatttccttattgatgcatcttttccccacctgtcactcaacgtggtccctanaacaagaagcttaaaacngggctttcacccaacctgctccctctgaatctcatcagggncagatcnntcacgtctcatctcaataannatcatttatatttcctg

SEQ ID NO: 185 - DNA, 912 bp, Human
catcaccatcaccatcacggatcctatttaggtgacactatagaatcgtcgacccacgcgtccgggaaagcccactctcccttttaccaggaaggcgtcagcaacgccctgctcaagatggctgagctggggctgacgcgggcggccgacgttctcttgcggcatggggccaatctcaactttgaagacccagtcacctactacacggccttgcacatcgccgtcctgcggaaccagccggacatggtggagctgctggtgcatcacggggccgacgttaatcggagggaccggatccacgagagtagccccttggacctggccagcgaggagcctgagcgcctgccctgcctgcagcgcctcctggaccttggagctgatgtcaatgccgctgacaagcatggaaaaactgctctgctccatgctctggccagcagcgacggggtgcagatccacaatactgagaacattcgtctcttactggaaggaggggcagacgtcaaggccaccaccaaagatggggacacagtgttcacctgcatcatcttcctgcttggtgagaccgtgggaggggacaaagaggaggcccagatgatcaaccgcttctgcttccaagtcacacggctgctgctggcacacggggccgaccccagcgagtgcccagcccacgagtccctcacccacatctgcctgaagagctttaaactgcacttccctctcctgcgcttcctcctggagtccggagccgcctacaactgctccctgcacggtgcgtcctgctggtctggctttcacatcatctttgagaggctctgttcccacccaggctgcacggaagacgagagccatgcggacctcctgcgcaaagctgagactgtcctgatctcatggtgaccaactctcagaaactcc

SEQ ID NO: 186 - DNA, 834 bp, Human
ctatgagaggatcgcatcaccatcaccatcacggatcctatttaggtgacactatagaatcgtcgacccacgcgtccgctgcgcgtcgtcctcctcgccctccaggccgcccgcgccgcgccggagtccgctgtccgccagctacccgcttcctgccgcccgccgctgccatgctgcccgccgcgctgctccgccgcccgggacttggccgcctcgtccgccacgcccgtgcctatgccgaggccgccgccgccccggctgccgcctctggccccaaccagatgtccttcaccttcgcctctcccacgcaggtgttcttcaacggtgccaacgtccggcaggtggacgtgcccacgctgaccggagccttcggcatcctggcggcccacgtgcccacgctgcaggtcctgcggccggggctggtcgtggtgcatgcagaggacggcaccacctccaaatactttgtgagcagcggttccatcgcagtgaacgccgactcttcggtgcagttgttggccgaagaggccgtgacgctggacatgttggacctgggggcagccaaggcaaacttggagaaggcccaggcggagctggtggggacagctgacgaggccacgcgggcagagatccagatccgaatcgaggccaacgaggccctggtgaaggccctggagtaggcggtgcgtacccggtgtcccgaggcccggccaggggctgggcagggatgccaggtgggcccagccagctcctggggtcccggccacctggggaagccgcgcctgccaaggaggccaccagagggcagtgcaggcttctgcctgggccccaggccct

SEQ ID NO: 187 - DNA, 711 bp, Human
  misc_feature (1)..(1): n is a, c, g, or t
nttataagagatactatgaaggtcgcatcaccatcaccatcacggatcctatttaggtgacactatagaatcgtcgactctggaccttggctgtcactcagttgcgttacttgctgcggaggaccgtgggcagccagggtcggtgaaggatcccaaaatggctgggcgaaaacttgctctaaaaaccattgactgggtagcttttgcagagatcataccccagaaccaaaaggccattgctagttccctgaaatcctggaatgagaccctcacctccaggttggctgctttacctgagaatccaccagctatcgactgggcttactacaaggccaatgtggccaaggctggcttggtggatgactttgagaagaagtttaatgcgctgaaggttcccgtgccagaggataaatatactgcccaggtggatgccgaagaaaaagaagatgtgaaatcttgtgctgagtgggtgtctctctcaaaggccaggattgtagaatatgagaaagagatggagaagatgaagaacttaattccatttgatcagatgaccattgaggacttgaatgaagctttcccagaaaccaaattagacaagaaaaagtatccctattggcctcaccaaccaattgagaatttataaaattgagtccaggaggaagctctggcccttgtattacacattctggacattaaaaataataattatac

SEQ ID NO: 188 - DNA, 880 bp, Human
  misc_feature (724)..(725): n is a, c, g, or t
  misc_feature (778)..(778): n is a, c, g, or t
gagatactatgagaggtcgcatcaccatcaccatcacggatcctatttaggtgacactatagaatcgtcgactctggaccttggctgtcactcagttaggacgtcgagctgctgcagatccaaggcctgtttcaacgcagcggggaccagctggccgaggaacgggcacagatcatctgggaatgtgcaggggaccaccgtgtggctgaggccctcaagaggctgcgcaggaagaggcccccaaggcagaaacccctgggccactcgctacaccactgcagccgcctcagaatcctggagccccactctgcactggccaacccacagagtgccacagagacagcctccagtgagcagtatctgcactctaggaagaaaagtgccaggatccgccggaactggaggaagtcaggccccacaagctacctccaccagatcagacactgatccagggaaagagccaggaatggcagtgtcttccctcttgccaaaaggcctggggaggtgaaggaagagagactttaggcaagcagcccaaaggggtaaatgaaagcaagaggctgctgccactgacctgctccattcagaacaagactggatgcttctgttgagctctccattatgtgggacccattcctcaccaaaatgaggagagacagtgactgttcctgccacagtccttcccagtctaacactattcctgggctgcatgatattcccctgnngagcaagtgacaggcacttagatgcagcatttcaccactcatgctactaatcnatctactgctactactgtaaaacatggttccagtagcctgttcacacccccacaccatcagatacacagggaaactgtagtttaagtggcaaataaaacttt

SEQ ID NO: 189 - DNA, 1201 bp, Human
  misc_feature (11)..(11): n is a, c, g, or t
  misc_feature (829)..(829): n is a, c, g, or t
  misc_feature (903)..(903): n is a, c, g, or t
  misc_feature (947)..(947): n is a, c, g, or t
  misc_feature (952)..(952): n is a, c, g, or t
  misc_feature (970)..(970): n is a, c, g, or t
  misc_feature (983)..(983): n is a, c, g, or t
  misc_feature (1007)..(1007): n is a, c, g, or t
  misc_feature (1033)..(1033): n is a, c, g, or t
  misc_feature (1041)..(1041): n is a, c, g, or t
  misc_feature (1054)..(1054): n is a, c, g, or t
  misc_feature (1062)..(1062): n is a, c, g, or t
  misc_feature (1068)..(1068): n is a, c, g, or t
  misc_feature (1071)..(1071): n is a, c, g, or t
  misc_feature (1078)..(1078): n is a, c, g, or t
  misc_feature (1095)..(1095): n is a, c, g, or t
  misc_feature (1099)..(1099): n is a, c, g, or t
  misc_feature (1106)..(1106): n is a, c, g, or t
  misc_feature (1108)..(1108): n is a, c, g, or t
  misc_feature (1118)..(1118): n is a, c, g, or t
  misc_feature (1122)..(1122): n is a, c, g, or t
  misc_feature (1124)..(1124): n is a, c, g, or t
  misc_feature (1134)..(1134): n is a, c, g, or t
  misc_feature (1139)..(1139): n is a, c, g, or t
  misc_feature (1142)..(1142): n is a, c, g, or t
  misc_feature (1155)..(1155): n is a, c, g, or t
  misc_feature (1159)..(1159): n is a, c, g, or t
  misc_feature (1163)..(1163): n is a, c, g, or t
  misc_feature (1169)..(1169): n is a, c, g, or t
  misc_feature (1173)..(1174): n is a, c, g, or t
  misc_feature (1179)..(1182): n is a, c, g, or t
  misc_feature (1187)..(1187): n is a, c, g, or t
  misc_feature (1193)..(1194): n is a, c, g, or t
agaaaattacntggagaggatcgcatcaccatcaccatcacgggatcctatttaggtgacactatagaatcgtcgacccacgcgtccggggcgtccgaggagagccaggccatgcaggcccacgtgtctattatcctcccagtccacaacgctgaaccgtggctggacgaatgtttgaggtctgttttgcaacaggactttgaaggtaccatggagctgtctgttttcaatgatgccagtaaggacaagtctggggctatcattgaaaaatggagagtgaagctggaagattctggtgtccatgtgatcattggggggcacgattctccctctcctagaggcgtcggatacgctaaaaatcaagcagttgcccagagctcagggtcttacctttgctttttggattcggatgacgtcatgatgccccagcgggtgaggctgcaacacgaggctgccgttcagcacccgtcgagcatcattggttgcagagtgaggagagatccccctaactccaccgaacgatacacacgttggatcaaccagctgacgccggagcagctcctaacccaggttttcacctcaaatggccccacggtgatcatgcccacctggttctgctcgcgagcgtggttctcccacgtgggcccctttaacgagggaggtcagggcgtcccggaggacctgctgttcttctacgagcacctcaggaagggcggcggcgtcatccgcgtggaccagagtctcctgctgtatcgccaccacccacaggcggccacgcactgcgtcctcgagacgaccatctggacccaccgcgtccgcttcctggaanaacaggccctgccccgctgggcggccttcaccatctggaacgctgggcaagcaggggcgccggctgtaccgcancttgactgccggcagccagcgcaaggggtggcattctgtgacgnggacnaaaacaagatcaggaaangcttctattgccnccaaggactctcaggaaaaaaccnaagcccccaaatccccatccctgcantttcgaancccgcccgggccnccctttcntcattntgngggaaanctgccctctcccccttnttanccaaagnanccaaaacccnttgnanggggggaaanaaggnccnccccccaaccccngggncctnggaagnaagnnccccnnnnggggncccccnnaaaaccc

SEQ ID NO: 190 - DNA, 946 bp, Human
tatgagaggtcgcatcaccatcaccatcacggatcctatttaggtgacactatagaatcgtcgacccacgcgtccgagccccagttcccaggggcctcggcggagtttatagataagttggaattcatccagcccaacgtcatctctggaatccccatctaccgcgtcatggaccggcaaggccagatcatcaaccccagcgaggacccccacctgccgaaggagaaggtgctgaagctctacaagagcatgacactgcttaacaccatggaccgcatcctctatgagtctcagcggcagggccggatctccttctacatgaccaactatggtgaggagggcacgcacgtggggagtgccgccgccctggacaacacggacctggtgtttggccagtaccgggaggcaggtgtgctgatgtatcgggactaccccctggaactattcatggcccagtgctatggcaacatcagtgacttgggcaaggggcgccagatgcctgtccactacggctgcaaggaacgccacttcgtcactatctcctctccactggccacgcagatccctcaggcggtgggggcggcgtacgcagccaagcgggccaatgccaacagggtcgtcatctgttacttcggcgagggggcagccagtgagggggacgcccatgccggcttcaacttcgctgccacacttgagtgccccatcatcttcttctgccggaacaatggctacgccatctccacgcccacctctgagcagtatcgcggcgatggcattgcagcacgaggccccgggtatggcatcatgtcaatccgcgtggatggtaatgatgtgtttgccgtatacaacgccacaaaggaggcccgacggcgggctgtggcagagaaccagcccttcctcatcgaggccatgacctacaggatcgggcaccacagcaccagtgacg

SEQ ID NO: 191 - DNA, 913 bp, Human
catcaccatcaccatcacggatcctatttaggtgacactatagaatcgtcgacccacgcgtccgcaagcaggttcctaaagcccagaaaggtggaagaagatgagctcttggaaaaatcaccactgcagctagggaatgagcctttgcaacgcttgctcagtgacaatggcatcaacagactatccctcatggcccctgacaccccggccggtaccccacttagtggtgtgggtcgccgcacatcagtcctcttcaagaaggccaagaatggggttaagctacagagaagcccagacagggtcctggagaatggcgaggaccatggtgtggcaggctctcctgcctctccagccagcatcgaggaagagcgccactcccggaagcggccaaggagcaggagctgtagtgagagcgaaggggagaggtccccccagcaggaggaagagacaggcatgaccaacggctttggaaaacacaccgaaagcgggtctgactctgaatgtagtttgggtctcagtggtggactggcatttgaagcttgcagtggtctgacgccccccaaacgcagccgtgggaagccagccctgtctcgagtgcccttcctggaaggtgtgaacggagactctgactacaatggctcaggcagaagcctcctgctgccctttgaagaccgcggagacctggagcccttggagctggtgtgggccaagtgccgaggctacccctcctaccctgccttgatcatcgatcccaagatgccccgggagggcctcctgcacaatggcgttcccatccctgtccccccgctggacgtgctgaagctgggagagcagaaacaggcagaggctggagagaagctcttccttgtcctcttctttgacaacaagcgcacctggcagtggcttccaaggg

SEQ ID NO: 192 - DNA, 845 bp, Human
  misc_feature (661)..(661): n is a, c, g, or t
aagagaatactatgagaggtcgcatcccatcaccatcacggatcctatttaggtgacactatagaatcgtcgactctggaccttggctgtcactcagttgacggggcggggctgaggccaaggaagaggttggactgtgtctcgcatgctcctgacgcagaaggttttgaaccttttttcacctcgtctgaaatggctgcctcccagtgtctctgctgctcaaaatttctcttccagagacagaacctcgcctgtttcctcacaaacccacactgtggcagccttgttaatgcagatggccatggtgaagtgtggacagattggaataatatgtccaagtttttccagtatggatggcgatgcaccactaatgagaatacctattcaaaccgtaccctgatgggcaactggaaccaggaaagatatgacctgaggaatatcgtgcagcccaaacccttgccttcccagtttggacactactttgaaacaacatatgatacaagctacaacaacaaaatgccactttcaacacatagatttaagcgagagcctcactggttcccaggacatcaacctgaactggatcctccccgatacaaatgcacagaaaagtcaacttacatgaatagctattcaaagccttaaattgggcatcactcangatgtgtataagatcttaatattgactagtttcacatccaggtttctaagaaatgataagatacttcacttttccagagtgaaatgtaggagggagcacattctaagtacagctaaaattttagctcactgtaacacagtttcactctctgaattaataaagcaaaaaacacagtaaaaaaaaa

SEQ ID NO: 193 - DNA, 646 bp, Human
  misc_feature (10)..(10): n is a, c, g, or t
  misc_feature (29)..(29): n is a, c, g, or t
  misc_feature (31)..(31): n is a, c, g, or t
  misc_feature (33)..(34): n is a, c, g, or t
  misc_feature (37)..(37): n is a, c, g, or t
  misc_feature (39)..(39): n is a, c, g, or t
  misc_feature (380)..(380): n is a, c, g, or t
  misc_feature (424)..(424): n is a, c, g, or t
  misc_feature (462)..(462): n is a, c, g, or t
  misc_feature (505)..(505): n is a, c, g, or t
  misc_feature (546)..(546): n is a, c, g, or t
  misc_feature (564)..(564): n is a, c, g, or t
  misc_feature (628)..(628): n is a, c, g, or t
taaaaattantttgctttgtagcggatanantnntantngattaattgtgagcggatacaatttacacagaattattaagaggagaaattactatgagaggatcgcatcaccatcaccatcacggatcctatttaggtgacactatagaatcgtcgacccacgcgtccgggccaggaggcgggaggcggttgccggctgcgcgccgaagcctgcgcgccagtcctccggccactgctatcgcccacggccgcaccatggccctaaaggccgagggcgccgcactcgactgcttcgaggtgacgctgaaatgcgaggaaggggaggacgaggaggaggccatggtggtggccgtaattccgcggcccgagccgatgctcanagtgacccaacaggagaagaccccaccgcctagacccagcccgntagaggcaggcagtgatggctgtgaggagccgaagcancaggtgtcttgggagcaggagttcctggtgggcagcagcccangaggcagcgggcgggcactgtgcatggtgtgtggcgctganatccgggcacccttcggncgacacagctcgctcgcacatcttggagcagcaccctcacaccttggacctgagcccttctganaagagcaatatcctggaa

SEQ ID NO: 194 - DNA, 854 bp, Human
  misc_feature (664)..(664): n is a, c, g, or t
  misc_feature (668)..(668): n is a, c, g, or t
  misc_feature (671)..(695): n is a, c, g, or t
tagagagatactatgagaggtcgcatcaccatcaccatcacggatcctatttaggtgacactatagaatcgtcgactctggaccttggctgtcactcagttaagcaaagtccaagggaccataaagccaagaaaacccttcaaagcaccccaaggaatgatgaccatggccttctaaccatgttgcctgatgaaatcttgaacagaggtcccggaaattcaaagaatacagaatttttgaaacatcaagcagtgaataactgctgtccctggaaaattggcaaaatggaaacatggcttcatgaacaagaggcccagggacagcttctctgggacagttccagctctgactcagatgagcaggggaaagatgagaagaagccacgagcactggtgagaaccaggacagagagaatcccacttttcgatgagttttttgatcaagaataagaatactattcattaacctagaaactgagtgctttgaaagcttgttttactctcaaaatcttccaaactgatatatgaattactttgaggacagcaaatcactttggtaaaaagaaatgatatctttagagtcttatgattaacaagtccgtcacatgtgctgttaactattgctgcataactaaatgcctcaaaacacaggggctaaccaaganaaanaannnnnnnnnnnnnnnnnnnnnnnnnaaaacgagcggccctccctatagtgagtcgtattaacttattagctgagcttggactccgttgataatccagtatgacctcaaactcctctggattgtcaaacgccggtgccgcgggcgtttttatggtgagatccagctagctgcgaatttcggacta

SEQ ID NO: 195 - DNA, 845 bp, Human
  misc_feature (589)..(589): n is a, c, g, or t
  misc_feature (595)..(595): n is a, c, g, or t
  misc_feature (703)..(703): n is a, c, g, or t
  misc_feature (722)..(722): n is a, c, g, or t
  misc_feature (730)..(730): n is a, c, g, or t
  misc_feature (750)..(750): n is a, c, g, or t
  misc_feature (772)..(772): n is a, c, g, or t
  misc_feature (777)..(777): n is a, c, g, or t
  misc_feature (788)..(788): n is a, c, g, or t
  misc_feature (792)..(792): n is a, c, g, or t
  misc_feature (798)..(798): n is a, c, g, or t
  misc_feature (800)..(800): n is a, c, g, or t
  misc_feature (804)..(804): n is a, c, g, or t
  misc_feature (813)..(815): n is a, c, g, or t
  misc_feature (820)..(820): n is a, c, g, or t
  misc_feature (824)..(825): n is a, c, g, or t
  misc_feature (836)..(836): n is a, c, g, or t
  misc_feature (845)..(845): n is a, c, g, or t
taagaggagaattaactatgagaggatcgcatcaccatcaccatcacggatcctatttaggtgacactatagaatcgtcgacccacgcgtccggctccttgctcggccgggccgcggccatgggagaggccgaggtgggcggcgggggcgccgcaggcgacaagggcccgggggaggcggccaccagcccggcggaggagacagtggtgtggagccccgaggtggaggtgtgcctcttccacgccatgctgggccacaagcccgtcggtgtgaaccgacacttccacatgatttgtattcgggacaagttcagccagaacatcgggcggcaggtcccatccaaggtcatctgggaccatctgagcaccatgtacgacatgcaggcgctgcatgagtctgagattcttccattcccgaatccagagaggaacttcgtccttccagaagagatcattcaggaggtccgagaaggaaaagtgatgatagaagaggagatgaaagaggagatgaaggaagacgtggacccccacaatggggctgacgatgttttttcatcttcagggagtttggggaaagcatcagaaaaatnccagcnaaagacaaagagaaaaactcctcagacttggggtgcaaagaaggcgcagacaaggggaagcggcagccgggtcaccgacaaaagtcctgaccgcaaaacagcaacccnttccagtcccagtgctgcnaagcggcngccgcacgtaaaaccctcanccctgggggcggcagaaaaacnggcgnaggcactgtgncccnctttangngggnttgtattgnnncttanctgnnccccccccccnggccccccn

SEQ ID NO: 196 - DNA, 632 bp, Human
agatactatgagaggtcgcatcaccatcaccatcacggatcctatttaggtgacactatagaatcgtcgactctggaccttggctgtcactcagtttttggagccttgctgggcactcctgtaggaggcctgctgatggcatttcagaagtactctggtgagactgttcaggaaagaaaacagaaggatcgaaaggcactccatgagctaaaactggaagagtggaaaggcagactacaagttactgagcacctccctgagaaaattgaaagtagtttacaggaagatgaacctgagaatgatgctaagaaaattgaagcactgctaaaccttcctagaaacccttcagtaatagataaacaagacaaggactgaaagtgctctgaacttgaaactcactggagagctgaagggagctgccatgtccgatgaatgccaacagacaggccactctttggtcagcctgctgacaaatttaagtgctggtacctgtggtggcagtggcttgctcttgtctttttcttttctttttaactaaaaatggggctgttgtactctcactttacttatccttaaatttaaatacatacttatgtttgtattaatctatcaatatatgcatacatgaatat

SEQ ID NO: 197 - DNA, 867 bp, Human
  misc_feature (1)..(2): n is a, c, g, or t
  misc_feature (770)..(772): n is a, c, g, or t
  misc_feature (784)..(785): n is a, c, g, or t
nnttatagagagattactatgagaggatgcatcccatcaccatcacggatcctatttaggtgacactatagaatcgtcgactctggaccttggctgtcactcagttcgggatgagtttctacaaaaagagatgtgggcccctctctggagtcgttcgatgaggccagggcgatggtgttctcagcgttcctgtgcatggcaaaccagcaataacactttgcacccactctggacggtcccggtctccgtgccagggggcacccggcagtctcctattaacatccagtggagggacagcgtctatgacccccagctgaagccactcagggtctcctatgaagcggcatcctgcctgtacatctggaacactggctacctcttccaggtggaatttgacgatgccaccgaggcatcagctgcatttagttcactggaattctgtgaaataccaaaattacaaggaagctgtcgtgggagagaatggtttggctgtgataggcgtgtttttaaagctcggggcccatcatcagacgctgcagaggctggtggacatcttgccggaaataaaacataaggacgcgcgggcggccatgcgccccttcgacccctccactctgctgcccacctgctgggattactggacctacgcgggctcgctcaccaccccgccgctgaccgagtcggtcacctggatcatccagaaagagcccgttgaagtggccccagccagctctctgcattcgtactctcctgtttctgcacttggtgannnagagagatgatnngtgacactatcgcccactcaaccctgagaaccggaggtctggcgtcttccaggcactatgagggccaggtcctaagaataag

SEQ ID NO: 198 - DNA, 853 bp, Human
  misc_feature (3)..(3): n is a, c, g, or t
  misc_feature (584)..(584): n is a, c, g, or t
  misc_feature (621)..(621): n is a, c, g, or t
  misc_feature (647)..(647): n is a, c, g, or t
  misc_feature (653)..(653): n is a, c, g, or t
  misc_feature (663)..(663): n is a, c, g, or t
  misc_feature (669)..(669): n is a, c, g, or t
  misc_feature (677)..(678): n is a, c, g, or t
  misc_feature (685)..(685): n is a, c, g, or t
  misc_feature (690)..(690): n is a, c, g, or t
  misc_feature (721)..(721): n is a, c, g, or t
  misc_feature (729)..(729): n is a, c, g, or t
  misc_feature (733)..(733): n is a, c, g, or t
  misc_feature (735)..(735): n is a, c, g, or t
  misc_feature (742)..(742): n is a, c, g, or t
  misc_feature (753)..(753): n is a, c, g, or t
  misc_feature (757)..(758): n is a, c, g, or t
  misc_feature (765)..(765): n is a, c, g, or t
  misc_feature (768)..(769): n is a, c, g, or t
  misc_feature (774)..(774): n is a, c, g, or t
  misc_feature (781)..(781): n is a, c, g, or t
  misc_feature (787)..(788): n is a, c, g, or t
  misc_feature (791)..(791): n is a, c, g, or t
  misc_feature (801)..(801): n is a, c, g, or t
  misc_feature (807)..(807): n is a, c, g, or t
  misc_feature (809)..(809): n is a, c, g, or t
  misc_feature (818)..(818): n is a, c, g, or t
  misc_feature (822)..(822): n is a, c, g, or t
  misc_feature (825)..(826): n is a, c, g, or t
  misc_feature (830)..(830): n is a, c, g, or t
  misc_feature (837)..(837): n is a, c, g, or t
ctntgagaggatcgcatcaccatcaccatcacggatcctatttaggtgacactatagaatcgtcgacccacgcgtccgcggacgcgtgggcagagcccagccggcgcggagcgggagcggtgcaggctgaggtctccgagcggctcgccatggctggcccgcagcagcagcccccttacctgcacctggccgagctgacggcgtcccagttcctggaaatatggaagcactttgacgcagacggaaatgggtatattgaaggtaaagagctagaaaactttttccaagagctggagaaggcaaggaaaggctctggcatgatgtcaaagagtgacaactttggagaaaagatgaaggagttcatgcagaagtatgataaaaactcagatgggaaaatcgagatggcagagctggcgcagatcctgccaaccgaagagaacttccttctgtgcttcaggcagcacgtgggctccagcgccgagtttatggaggcttggcggaagtacgacacagacaggagtggctacatcgaagccaatgagctcaagggattcctgtcagacctgctgaagaaggcgaaccgnccgtacgatgagcccaagctccaggaatacccccaanccatactacggatgtttgacttgaancggggnatgccaaatngggccntctcaaanntgtcccngaccncctgcctgtccaggaaaaacttccctgcttnaaatttcngggncntgaaagntgacccctcanaagnngttttanccnngatcntttcccntttttnnccnacaaaggatnagaaancnggcttactnttgnccnnagcnttgaggnttggaatggccctttt

SEQ ID NO: 199 - DNA, 875 bp, Human
  misc_feature (3)..(3): n is a, c, g, or t
  misc_feature (657)..(657): n is a, c, g, or t
  misc_feature (670)..(671): n is a, c, g, or t
  misc_feature (722)..(722): n is a, c, g, or t
  misc_feature (731)..(731): n is a, c, g, or t
  misc_feature (742)..(742): n is a, c, g, or t
  misc_feature (752)..(752): n is a, c, g, or t
  misc_feature (766)..(766): n is a, c, g, or t
  misc_feature (772)..(772): n is a, c, g, or t
  misc_feature (778)..(778): n is a, c, g, or t
  misc_feature (780)..(780): n is a, c, g, or t
  misc_feature (783)..(783): n is a, c, g, or t
  misc_feature (789)..(789): n is a, c, g, or t
  misc_feature (792)..(792): n is a, c, g, or t
  misc_feature (807)..(807): n is a, c, g, or t
  misc_feature (811)..(811): n is a, c, g, or t
  misc_feature (816)..(816): n is a, c, g, or t
  misc_feature (822)..(822): n is a, c, g, or t
  misc_feature (835)..(835): n is a, c, g, or t
  misc_feature (863)..(863): n is a, c, g, or t
  misc_feature (869)..(869): n is a, c, g, or t
  misc_feature (873)..(873): n is a, c, g, or t
ganaaattaactatgagaggatcgcatcaccatcaccatcacggatcctatttaggtgacactatagaatcgtcgacccacgcgtccgagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggcccctggccatccgggaacagtgagcgacagggcaaggcccaggtggagattgtccactggatggggnaggagcctgctgnngatgaatccaaggtccctggggccccaagccctgctctgaaggagggcaanccctgaggnaagaacctccncagcttgaanaaggcaaatgcccnaggccngaagcntntgntataanggntctcttgatgccccntggnacaanatgaancctgaaccaaagnggggtttgaattccaggccccattttgncccttngaanct

SEQ ID NO: 200 - DNA, 1348 bp, Human
  misc_feature (1)..(1): n is a, c, g, or t
  misc_feature (793)..(793): n is a, c, g, or t
  misc_feature (805)..(805): n is a, c, g, or t
  misc_feature (1182)..(1182): n is a, c, g, or t
  misc_feature (1198)..(1198): n is a, c, g, or t
  misc_feature (1255)..(1255): n is a, c, g, or t
  misc_feature (1262)..(1262): n is a, c, g, or t
  misc_feature (1269)..(1270): n is a, c, g, or t
  misc_feature (1274)..(1274): n is a, c, g, or t
  misc_feature (1313)..(1313): n is a, c, g, or t
  misc_feature (1341)..(1342): n is a, c, g, or t
  misc_feature (1348)..(1348): n is a, c, g, or t
nggatatactgacttacctataaataggcgtatcacgaggccctttcgtcttcacctcgagaaatcataaaaaatttatttgctttgtgagcggataacaattataatagattcaattgtgagcggataacaatttcacacagaattcattaaagaggagaaattaactatgagaggatcgcatcaccatcaccatcacggtcgacccacgcgtccgggctacatggccttcctcacctatgatgaggtccaagagcgtctgcaggcctgcagggacaagccaggcagttacatcttccggcccagctgtactcgcctggggcagtgggccatcggctatgtgagctcagatggcagcatcctgcagaccatccctgccaacaaacccctgtcccaggtgctcctggagggacagaaggacggcttctacctctacccagatggaaagacccacaacccagacctgactgagctcggccaggcagaaccccagcagcgcatccacgtgtcagaggagcagctgcagctctactgggccatggactccacatttgagctctgcaagatctgtgctgagagcaacaaggatgtgaagattgagccgtgcgggcacctgctctgcagctgctgcctggctgcctggcagcactcggacagccagacctgccccttctgccgctgcgagattaagggctgggaggccgtgagtatctaccagttccacggtcaggctactgctgaggactcagggaacagcagtgaccaggaaggcagggagttggagctggggcangtgcccctttcngctcctccattgcccccacggccagatctgccccccaggaagcccagaacggccgcgatccgcatgcgagctcgattacctgaacctggactcctgttgataaaatcagtaatgaccctcaaactccatctggatttgttcaaaaaccccggttggcccccgggcgttttttattgggaaaaatccaactacttagggaaaatttccggaactaggaaaccaaaaggaaaaaaaaacccacgaaaataccaccatgaaaaaacccaaggcctcaaaaaaaaattaaaggatttccacaaccattaagcacctaaaacagaccgtatacgaagattcccgcccttttaacccgtaaaaaaacacacacaaattacctnccctaaccccattcanccacaaaaaacagccccccaatttcatacacaaaaaacgaaacacgaataacccacnacccccntccacannactntaaaaaccacaaatccacaccgacaaaaaaaccacccancacataccaaaaccccactaaaaacgannaaacan

SEQ ID NO: 201 - DNA, 632 bp, Human
tgagaggatcgcatcaccatcaccatcacggatcctatttaggtgacactatagaatcgtcgacccacgcgtccgcaggactgtcccctggcgatctggatgtctttgttcggtttgacttcccctatcccaacgtggaagaagctcagaaagacaagaccagtgtgatcaagaacacagactcccctgagttcaaggagcagttcaaactctgcatcaaccgcagccaccgtggcttccgaagggccatccagaccaagggcatcaagttcgaagtggttcacaagggggggctgttcaagactgaccgggtgctggggacagcccagctgaagctggatgcactggagatagcatgtgaggtccgggagatccttgaggtcctggatggtcgccggcccacaggggggcgactggaggtaatggtccggattcgggagccactgacagcccagcagttggagacgacgacagagaggtggctggtcattgaccctgtgccggcagctgtgcccacacaggttgctgggcccaaagggaaggcccctcctgtgcctgcccctgcaagggagtcagggaacagatcagcccggcccctgcatagcctcagtgtgctggcgtttgaccaagag

SEQ ID NO: 202 - DNA, 1152 bp, Human
  misc_feature (742)..(742): n is a, c, g, or t
  misc_feature (768)..(768): n is a, c, g, or t
  misc_feature (806)..(806): n is a, c, g, or t
  misc_feature (821)..(821): n is a, c, g, or t
  misc_feature (843)..(843): n is a, c, g, or t
  misc_feature (855)..(855): n is a, c, g, or t
  misc_feature (903)..(903): n is a, c, g, or t
  misc_feature (907)..(907): n is a, c, g, or t
  misc_feature (911)..(911): n is a, c, g, or t
  misc_feature (928)..(928): n is a, c, g, or t
  misc_feature (958)..(958): n is a, c, g, or t
  misc_feature (966)..(966): n is a, c, g, or t
  misc_feature (972)..(972): n is a, c, g, or t
  misc_feature (987)..(987): n is a, c, g, or t
  misc_feature (994)..(994): n is a, c, g, or t
  misc_feature (1006)..(1006): n is a, c, g, or t
  misc_feature (1008)..(1008): n is a, c, g, or t
  misc_feature (1015)..(1015): n is a, c, g, or t
  misc_feature (1022)..(1022): n is a, c, g, or t
  misc_feature (1025)..(1025): n is a, c, g, or t
  misc_feature (1028)..(1028): n is a, c, g, or t
  misc_feature (1030)..(1030): n is a, c, g, or t
  misc_feature (1036)..(1036): n is a, c, g, or t
  misc_feature (1038)..(1038): n is a, c, g, or t
  misc_feature (1042)..(1042): n is a, c, g, or t
  misc_feature (1054)..(1054): n is a, c, g, or t
  misc_feature (1056)..(1056): n is a, c, g, or t
  misc_feature (1060)..(1060): n is a, c, g, or t
  misc_feature (1072)..(1072): n is a, c, g, or t
  misc_feature (1074)..(1074): n is a, c, g, or t
  misc_feature (1077)..(1077): n is a, c, g, or t
  misc_feature (1085)..(1085): n is a, c, g, or t
  misc_feature (1093)..(1094): n is a, c, g, or t
  misc_feature (1098)..(1098): n is a, c, g, or t
  misc_feature (1109)..(1109): n is a, c, g, or t
  misc_feature (1114)..(1114): n is a, c, g, or t
  misc_feature (1137)..(1138): n is a, c, g, or t
  misc_feature (1142)..(1142): n is a, c, g, or t
  misc_feature (1149)..(1149): n is a, c, g, or t
  misc_feature (1151)..(1151): n is a, c, g, or t
tagagaaattactatgagaggatcgcatcaccatcaccatcacggatcctatttaggtgacactatagaatcgtcgacccacgcgtccgggagatggcgggagctggtcgcggagcagcggtgtccagggtgcaggcgggtcctgggagtccccggcgagcgcgggggcggcagcaagtgcagccgctggggaagcagcgcccagccccgtggcccgggcttcgcaggtgactgcgctgccccgcgaggccgccacacttccccagagaaggggacgccttgaaggctccgcccgggaccccctagggagcgttcgctcggaccccttccccagcaaagagaagaagaaagtgaactgcaagcccaagaaccaggacgaacaggagattcctttccggctccgggagattatgaggagccgccaagagatgaaaaacccgatcagtaacaagaagaggaagaaagcagcccaggtgaccttcagaaagacattggagaaggaagcaaagggagaggagcccgacatcgcagtccccaagttcaaacagaggaagggggagtccgacggggcctatatccaccgcatgcagcaagaggcccagcatgtgctgttcctcagcaagaaccaggccatccggcagccagaggtgcaggcagctcccaaggagaagtctgagcagaaaaaagcaaaaaaagcgtgagtggaggcgggagggggaggggtctgccctgggagccgganggaagacattgggttcccatgacggnccctctgcaggtaccctgtttcatagccatgggggcancctggattcaggganaccaagccagaacccttggganttggcgagtcgnaacatccagctgggaaccagtgagggtgtggcctccagaaggctgcgnaacntggnaactctgcggaaaaccncccttggtccttgctttcccaggaaaagcnccaaaaanccctanccctgtgggaatcanccctganggggtcgttctnanggtgacntgcccanggnttntnttttcntnaaanaaaatttttttncntccnaaaaaaaataancnttncttatttntttaaaanntttngccaaataaantgggnttccccccttttaatccccaccnntttnggaaggntna

SEQ ID NO: 203 - DNA, 1158 bp, Human
  misc_feature (1)..(3): n is a, c, g, or t
  misc_feature (863)..(863): n is a, c, g, or t
  misc_feature (866)..(866): n is a, c, g, or t
  misc_feature (868)..(868): n is a, c, g, or t
  misc_feature (966)..(966): n is a, c, g, or t
  misc_feature (999)..(999): n is a, c, g, or t
  misc_feature (1003)..(1003): n is a, c, g, or t
  misc_feature (1036)..(1036): n is a, c, g, or t
  misc_feature (1059)..(1059): n is a, c, g, or t
  misc_feature (1063)..(1063): n is a, c, g, or t
  misc_feature (1065)..(1065): n is a, c, g, or t
  misc_feature (1067)..(1067): n is a, c, g, or t
  misc_feature (1070)..(1070): n is a, c, g, or t
  misc_feature (1078)..(1078): n is a, c, g, or t
  misc_feature (1080)..(1080): n is a, c, g, or t
  misc_feature (1096)..(1098): n is a, c, g, or t
  misc_feature (1101)..(1101): n is a, c, g, or t
  misc_feature (1105)..(1105): n is a, c, g, or t
  misc_feature (1117)..(1117): n is a, c, g, or t
  misc_feature (1127)..(1128): n is a, c, g, or t
  misc_feature (1130)..(1130): n is a, c, g, or t
  misc_feature (1141)..(1141): n is a, c, g, or t
  misc_feature (1155)..(1156): n is a, c, g, or t
nnntagagaaaattactatgagaggatcgcatcaccatcaccatcacggatcctatttaggtgacactatagaatcgtcgacccacgcgtccgagaaaaagcaggacctgtatgtggaccagctcaccactcgagcccagcaactggaagaagacattgccctgtttgaggctcagtacttggcccaagctgaggacacccggattttaaggaaagcagtgagtgaggcctgcaccgagatcgacgccatcagcgtggagaagaggcgcatcatgcagcaatgggccagcagcctggtgggcatgaagcaccgcgacgaggcgcacagggcggtgctggaggcgctcagaggatgccagcatcaagccaaatccaccgacggcgagattgaggcctataagaaatccatcatgaaggaggaagaaaagaacgagaagctggcgagcatcctgaaccggacagagacggaagccacactgctgcagaagctcaccacccagtgcctgaccaagcaggtggccctgcagagccagttcaatacctacaggctcaccctgcaggacacagaggatgccctcagccaggaccagctggaacaaatgatactcacggaggagttgcaggccatccgccaagccatccagggcgagctggagctcaggaggaagacggatgcggccatccgggagaagctgcaggagcacatgacctccaacaagaccaccaaatacttcaaccagctcatcctgaggctgcagaaggagaagaccaacatgatgacacatctttccaaaatcaacggtgacattgcccagaccaccctggacatcacacacaccagcagcaggctggacgcacaccanaananccttggtggagctggaccaggacgtgaagaaagtcaacgagctcatcaccaacagccagagcgagatctcccggcgcacgatcttgatcgagaggaancagggctcatcacttcctcacaagcaactggancganggtctccaactggggggaaaaatggggccctgnacttgaatcaaggctaacaactnatcncnanccnatgcaggngntccagccaaatactgnnnccntgcncagaaagtcagntaccagaacnnanaacactgctcntgacctccaaaagnntc

SEQ ID NO: 204 - DNA, 837 bp, Human
  misc_feature (741)..(741): n is a, c, g, or t
agatactatgagaggtcgcatcccatcaccatcacggatcctatttaggtgacactatagaatcgtcgactctggaccttggctgtcactcagttgaggaccctgaccccaagatggcggcgcccagcgaagtggccgcgatagcccctggcgaaggcgatggcggaggcggcggctttggctcctggctggacggacggttggaggcactgggagtggaccgagccgtttatggagcctacatcttgggtatcctgcaggaggaggaggaagaagagaagctggacgctctgcaggggatcctctctgctttcctggaagaagattccctccttaatatctgcaaggagattgtggaacgatggtcagaaactcagaatgttgtcaccaaagtgaaaaaagaagatgaagtacaggccattgccaccctaattgagaagcaggcacaaatcgtagtaaagccaaggatggtgtcagaagaggagaagcagagaaaagctgccctcctggcccagtatgctgatgtgacagatgaagaggaatatcctttctggagtctcggcaccattccctaaagctcaagccagacatatttgtgggtttacagtgacctttggcaagttgctaatccccctctatagcttaattttcccctctaaaatggcagtaatctatggccctttgtggatatgcggagtgatattggattagttgatactggacttatattttttcacacantatcattatattcctgaaaactttggtgtaaaacaataatgtcttaatagtcatttatattatgctttcaaaaatacaatatagctgtaattcttt

SEQ ID NO: 205 - DNA, 629 bp, Human
  misc_feature (9)..(9): n is a, c, g, or t
  misc_feature (18)..(18): n is a, c, g, or t
  misc_feature (46)..(47): n is a, c, g, or t
  misc_feature (52)..(52): n is a, c, g, or t
  misc_feature (74)..(74): n is a, c, g, or t
tcgagaatntaaaaattntttgctttgtgagcggatacaatttaanngattnattgtgagcggataacaatttncacagaattcattaaagaggagaaattaactatgagaggatcgcatcaccatcaccatcacggatcctatttaggtgacactatagaatcgtcgacccacgcgtccgcccacgcgtccgaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgttgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtccctgagggagatcaacaccatcctcaagtcccagcatcccaacattgtcaccgttagagtgagcatggccccacc

SEQ ID NO: 206 - DNA, 1215 bp, Human
  misc_feature (864)..(864): n is a, c, g, or t
  misc_feature (908)..(908): n is a, c, g, or t
  misc_feature (917)..(917): n is a, c, g, or t
  misc_feature (948)..(948): n is a, c, g, or t
  misc_feature (959)..(959): n is a, c, g, or t
  misc_feature (987)..(987): n is a, c, g, or t
  misc_feature (990)..(990): n is a, c, g, or t
  misc_feature (998)..(998): n is a, c, g, or t
  misc_feature (1005)..(1005): n is a, c, g, or t
  misc_feature (1036)..(1036): n is a, c, g, or t
  misc_feature (1048)..(1048): n is a, c, g, or t
  misc_feature (1060)..(1060): n is a, c, g, or t
  misc_feature (1063)..(1063): n is a, c, g, or t
  misc_feature (1066)..(1066): n is a, c, g, or t
  misc_feature (1070)..(1070): n is a, c, g, or t
  misc_feature (1085)..(1085): n is a, c, g, or t
  misc_feature (1091)..(1091): n is a, c, g, or t
  misc_feature (1093)..(1093): n is a, c, g, or t
  misc_feature (1099)..(1099): n is a, c, g, or t
  misc_feature (1102)..(1103): n is a, c, g, or t
  misc_feature (1119)..(1119): n is a, c, g, or t
  misc_feature (1125)..(1125): n is a, c, g, or t
  misc_feature (1132)..(1132): n is a, c, g, or t
  misc_feature (1140)..(1140): n is a, c, g, or t
  misc_feature (1145)..(1145): n is a, c, g, or t
  misc_feature (1151)..(1152): n is a, c, g, or t
  misc_feature (1155)..(1155): n is a, c, g, or t
  misc_feature (1163)..(1164): n is a, c, g, or t
  misc_feature (1167)..(1167): n is a, c, g, or t
  misc_feature (1181)..(1181): n is a, c, g, or t
  misc_feature (1184)..(1184): n is a, c, g, or t
  misc_feature (1187)..(1187): n is a, c, g, or t
  misc_feature (1190)..(1190): n is a, c, g, or t
  misc_feature (1194)..(1195): n is a, c, g, or t
  misc_feature (1201)..(1201): n is a, c, g, or t
gagaaattactatgagaggatcgcatcaccatcaccatcacggatcctatttaggtgacactatagaatcgtcgacccacgcgtccgcggctgcggcgctttgtgctccagtcgctcctaacgctccctggcccggccggggccgcgcagttagggcatctgaggcggggagaagcggcggggagacgccggctgccagcatgtcgctgcctccggagaaagcctccgagctgaagcagctcatccaccagcagctgagcaagatggatgtccatggtagaataagagaaatccttgctgagactatacgggaagaattggcacctgatcaacagcatttatcaacagaagatttgatcaaagcccttagacgtcgaggaatcattgacgatgtgatgaaagaacttaattttgttactgacagtgttgagcaagaactcccttcctctccaaaacaacctatttgttttgatagacaatcgacattaaaaaaaactaatattgatccaacacggaggtatctttaccttcaggttttgggtggaaaagctttcttggaacatctgcaagaacctgagcctttacctggacaagtttgttcaacgtttactttatgtttacattatcgaaaccaacgttttcgttctaaacctgttccatgtgcctgtgaaccagattttcatgatggctttttacttgaagtacacagagaaagcttgggtgatggaactagaatggctgattcaacaacaatgttatcaataagtgatccaattcatatggtgctaatcaaaacagacatatttggtgagacgactttagtagcatcatattttctggaatggcgatcggttttgggctcanaaaatggagtgaccagtctgactgtggaacttatgggtgcacanaatcaaaangtttctgtgggaatttaaatataaaacttgnaaatgtatccnccactcaatcaaacgttatctcaagaantantgaacacncagctgnctttggaacgtcaaaaactgcaaaaaaaaancgattatttctngtatatgctaancanggngganaaatattgcaattcnacctcnanaactcngannggttaaaattttgccnggttgnaaattanttaaaaantttangccggnnttnaaatttannggnaggggggaaattcnttnaanttntttnnaaaggnttcccaaaaaaaaa

SEQ ID NO: 207 - DNA, 1419 bp, Human
  misc_feature (6)..(9): n is a, c, g, or t
  misc_feature (909)..(909): n is a, c, g, or t
  misc_feature (932)..(932): n is a, c, g, or t
  misc_feature (936)..(936): n is a, c, g, or t
  misc_feature (1060)..(1060): n is a, c, g, or t
  misc_feature (1287)..(1287): n is a, c, g, or t
gccacnnnnttaagagatactagagaggatgcatcaccatcaccatcacggtcgacccacgcgtccgcccacgcgtccggcggggcgggccagcgccgggggtcgtggccgggacacgtggtacggaaccggcgccgcgcttgctgctggtaacagggccttgcctagtgggccttccttcccaggtcgcccgtcagtctccactagagacaggactgaccagttgctcttccttccaagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccagagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgcatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactacgtctgcatttctgacaattactggctgggaaagaagaagccctgcatcaccctacggctcangggcatttgctactttttcatcngagntggagtgcagcaacaaagacctcattcttggggtgtaggggggctcggtgcatgaggccatgactgatctcattttgctgatggcttccttgggggacaaaagggggaacatcctgatcccccnaattacgaaggccctggccgccgtcaccgaaaagaacccagctgtacgacgactcgctttgaaattaaaggaattgccaaggattgggggggccgaatcctcctggcaaccacaaaaaaaaacctcatggcccgaggggggaaccgcccttgcccccaatggataaaaggcccttttttggtttgggccaaccaggatctccaaaagggggtggcattctcctccgntccgcgcaaaatttctcaaaccgcgcggggctcaaactctaaataaaagtgttaacacccccccctatattggattgtcccccggagaaccccccccctctccccctcactactggaaaaaaaaaaaacatt

SEQ ID NO: 208 - DNA, 835 bp, Human
tgagaggtcgcatcaccatcaccatcacggatcctatttaggtgacactatagaatcgtcgacccacgcgtccgagcagctgcaggacctgagtggacagcaccagcaggagctggccagtcagctagctcagttcaaggtggaaatggcagaacgagaggaacggcaacagcaggtggctgaggactacgagctcagactggcccgggagcaagcgcgagtgtgcgaactgcagagtgggaaccagcagctggaggagcagcgggtggagctggtggaaagactgcaggccatgctgcaggcccactgggatgaggccaaccagctgctcagcaccactctcccgccgcccaaccctcaagctcctcctgctggaccctccagccccgggcctcaggagccggagaaggaggagaggagggtctggactatgcctcccatggccgtggccctgaagcctgtattgcagcagagccgggaagcaagggacgagctacctggagcgcctcctgttctttgcagttcctcctcagatcttagcctcctgttgggcccctcttttcagagccagcattctttccagcccctggagcccaaaccagacctcacttcatccacagctggggccttctctgcacttggggccttccatcccgatcatagggcagaaaggccattccctgaggaagatcctggacctgacggggagggcctcctaaagcaagggctgccgcctgctcagctggagggcctcaagaattttttgcaccagttgctggagacagtgccccagaacaatgagaacccttctgtcgacctgttgccccctaagtct

SEQ ID NO: 209 - DNA, 775 bp, Human
  misc_feature (588)..(588): n is a, c, g, or t
  misc_feature (710)..(710): n is a, c, g, or t
  misc_feature (742)..(742): n is a, c, g, or t
agatactatgagaggtcgcatcaccatcaccatcacggatcctatttaggtgacactatagaatcgtcgactctggaccttggctgtcactcagttagaagcactgacaaccagaggcaacagcaattaaatgacgtggtaaaaaattcatctactattatccagaatccagtagagacacccaagaaggactatagtctgttaccactgttaacagctgcccctcaagttggagaaaagattgcatttaagcttttggagctaacatccagttactcccctgatgtctctgactacaaggaaggaagaatattaagccacaatccagagacccagcaagtagatatagaaattctttcatccttacctgccttgagagaacctgggaaatttgatttagtttatcacaatgaaaatggagccgaggtagtggagtacgctgtgacacaggagagcaagatcactgtattttggaaagagttgattgacccaagactgattattgaatctccaagtaacacatcaagtacagaacctgcctgagtatgacctctccaccttatagtttatgaatgtcttgtttgtganagtgactataacccaaacttttttttttttttaaagaggatttggaagttgtatggattttttttgtaatcttcactttactgcataggaaacaatctacctcatcatttaaatgactgggntgtcggttttgtagatctttggtttttttggncggttaattttcgttacaaaatgtaaacatgac

SEQ ID NO: 210 - DNA, 528 bp, Human
atggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggaaaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatag

SEQ ID NO: 211 - DNA, 875 bp, Human
  misc_feature (685)..(685): n is a, c, g, or t
  misc_feature (735)..(735): n is a, c, g, or t
  misc_feature (831)..(831): n is a, c, g, or t
  misc_feature (838)..(839): n is a, c, g, or t
  misc_feature (864)..(864): n is a, c, g, or t
  misc_feature (871)..(871): n is a, c, g, or t
aataagagattactatgagaggtcgcatcaccatcaccatcacggatcctatttaggtgacactatagaatcgtcgactctggaccttggctgtcactcagttaacgaggagatcgcgttccttaagaaagtgcatgaagaggagatccgtgagttgcaggctcagcttcaggaacagcaggtccaggtggagatggacatgtctaagccagacctcactgccgccctcagggatatccgggctcagtatgagaccatcgcggctaagaacatttctgaagctgaggagtggtacaagtcgaaggtgtcagacctgacccaggcagccaacaagaacaacgacgccctgcgccaggccaagcaggagatgatggaataccgacaccagatccagtcctacacctgcgagattgacgccctcaagggcactaacgattccctgatgaggcagatgcgggaattggaggaccgatttgccagtgaggccagtggctaccaggacaacattgcacgcctggaggaggaaatccggcacctcaaggatgagatggcccgccatctgcgcgagtaccaggacctgctcaacgtgaagatggccctggatgtggagattgccacctaccggaagctgctggagggagaggagagccggatcaatctccccatccagacctactctgccctncacttccgagaaaccagccctgagcaaaggggttctgaggtccataccangaagacggtgatgatcaagaccatcgagacacgggatggggaggtcgtcagtgaggcacacagcagcagcatgaagtgctctaaagacgagacccntctgcanncagagacgtcctcaccctgtcctcntgctccntgaa

SEQ ID NO: 212 - DNA, 1014 bp, Human
tgagaggtcgcatcaccatcaccatcacggatcctatttaggtgacactatagaatcgtcgacccacgcgtccgatcttggttctcctgaagatttcctctccaaagccttagatcctcctcagctccaagtgatcagcaatgcaatgaatttgctccgaaaaattggagcttgtgaattaaatgagcctaaactgactccgttgggccaacaccttgcagctttacctgtgaatgtcaagattggcaagatgcttatttttggtgccatatttggctgccttgacccagtggcaacactagctgcagttatgacagagaagtctccttttaccacaccaattggtcgaaaagatgaagcagatcttgcaaaatcagctttggccatggcggattcagaccacctgacgatctacaatgcatatctaggatggaagaaagcacgacaagaaggaggttatcgttctgaaatcacatactgccggaggaactttcttaatagaacatcactgttaaccctagaggatgtaaagcaggagttaataaagttggttaaggcagcaggattttcatcttccacaacttctaccagctgggaaggaaacagagcctcacagaccctctcattccaagaaattgcccttcttaaagctgtactggtggctggactgtatgacaatgtggggaagataatctatacaaagtcagtggatgttacagaaaaattggcttgcattgtggagacggcccaaggcaaagcacaagtacacccatcctcagtaaatcgagatttgcaaactcatggatggctcttataccaggagaagataaggtatgccagagtgtatttgagagaaactaccctaataaccccttttccagttttactttttggtggtgatatagaagttcagcaccgagaacgtcttctttctattgatggctggatctattttcaggcccctgtaaagatagctgtcattttcaagcagctgagagttctcattgattcagt

SEQ ID NO: 213 - DNA, 718 bp, Human
ttttttattctggaattaacctataaaaataggcgtatcacgaggccctttcgtcttcacctcgagaaatcataaaaaatttatttgctttgtgagcggataacaattataatagattcaattgtgagcggataacaatttcacacagaattcattaaagaggagaaattaactatgagaggatcgcatcaccatcaccatcacggtcgacccacgcgtccgcggccgccctcgcggccggccctcggccgcggggtggaccaagctttgccgcaagaacgccgggctcctgtcactccttcctccgcctctcgctaccaccgccgacggtcttcagggtcacgagatgagcgctatcggtcagacgtccacacggaagctgtccaggcggctctggccaaacacaaagagcggaagatggcagtgcctatgccttccaaacgcaggtccctggtcgtgcagacctcgatggacgcctacacccctccagatacctcttctggctcagaagatgaaggctcagtgcagggggactcccagggcacccccacctccagccagggcagcatcaatatggagcactggatcagccaggccatccacggctccaccacgtccaccacctcctcgtcctctacgcagagcgggggcagcggggctgcccacaggctggcggacgtcatggctcagacccacatagaaaatcattctgcacctc

SEQ ID NO: 214 - DNA, 895 bp, Human
  misc_feature (1)..(4): n is a, c, g, or t
  misc_feature (771)..(772): n is a, c, g, or t
  misc_feature (774)..(775): n is a, c, g, or t
  misc_feature (801)..(802): n is a, c, g, or t
  misc_feature (808)..(808): n is a, c, g, or t
  misc_feature (813)..(813): n is a, c, g, or t
  misc_feature (853)..(853): n is a, c, g, or t
nnnnaatatagagagaatactatgagaggatgcatcaccatcaccatcacggatcctatttaggtgacactatagaatcgtcgactctggaccttggctgtcactcagttaaagagactcttcctaatgtccgggtggccaacgatgctcgagagctggtggtgaactgctgcactgaattcattcaccttatatcttctgaagccaatgagatttgtaacaaatcggaaaagaagaccatctcaccagagcatgtcgtacaagcactagaaagtttgggatttggctcttacatcagtgaagtaaaagaagtcttgcaagagtgtaaaacagtagcattaaaaagaagaaaggccagttctcgtttggaaaaccttggcattcctgaagaagagttattgagacagcaacaagaattatttgcaaaagctagacagcaacaagcagaattggcccaacaggaatggcttcaaatgcagcaagctgcccaacaagcccagcttgctgctgcctcagccagtgcatctaatcaggcgggatcttctcaggatgaagaagatgatgatgatatctgaaattcaccagctgagtttctatttcttctataaatgtttttccctgcacaacaaaaacagtgaaagaaatgcttatctgtaattttgtatgcatcttggtggacttgtcattggtattctagggatgtctgctattaagtttcatctattgtgtgctatacatgtaaaaactgtctctttgaaactatgaaaattnnannggtcagtatatatcaattttgaattnnttatgntgttnatgaaatttagatagcagcgagtccttcgttgatcataancagtgtacagaaacttcagttataaatacagtgaattctaca

SEQ ID NO: 215 - DNA, 1280 bp, Human
  misc_feature (849)..(849): n is a, c, g, or t
  misc_feature (944)..(944): n is a, c, g, or t
  misc_feature (974)..(975): n is a, c, g, or t
  misc_feature (994)..(994): n is a, c, g, or t
  misc_feature (999)..(999): n is a, c, g, or t
  misc_feature (1008)..(1008): n is a, c, g, or t
  misc_feature (1014)..(1014): n is a, c, g, or t
  misc_feature (1017)..(1017): n is a, c, g, or t
  misc_feature (1035)..(1035): n is a, c, g, or t
  misc_feature (1040)..(1040): n is a, c, g, or t
  misc_feature (1051)..(1051): n is a, c, g, or t
  misc_feature (1067)..(1067): n is a, c, g, or t
  misc_feature (1073)..(1073): n is a, c, g, or t
  misc_feature (1089)..(1089): n is a, c, g, or t
  misc_feature (1091)..(1091): n is a, c, g, or t
  misc_feature (1093)..(1093): n is a, c, g, or t
  misc_feature (1095)..(1095): n is a, c, g, or t
  misc_feature (1103)..(1103): n is a, c, g, or t
  misc_feature (1106)..(1106): n is a, c, g, or t
  misc_feature (1133)..(1133): n is a, c, g, or t
  misc_feature (1135)..(1135): n is a, c, g, or t
  misc_feature (1139)..(1139): n is a, c, g, or t
  misc_feature (1144)..(1144): n is a, c, g, or t
  misc_feature (1146)..(1146): n is a, c, g, or t
  misc_feature (1150)..(1150): n is a, c, g, or t
  misc_feature (1158)..(1158): n is a, c, g, or t
  misc_feature (1165)..(1165): n is a, c, g, or t
  misc_feature (1168)..(1168): n is a, c, g, or t
  misc_feature (1172)..(1172): n is a, c, g, or t
  misc_feature (1176)..(1176): n is a, c, g, or t
  misc_feature (1183)..(1183): n is a, c, g, or t
  misc_feature (1186)..(1186): n is a, c, g, or t
  misc_feature (1190)..(1190): n is a, c, g, or t
  misc_feature (1194)..(1194): n is a, c, g, or t
  misc_feature (1212)..(1212): n is a, c, g, or t
  misc_feature (1215)..(1216): n is a, c, g, or t
  misc_feature (1218)..(1218): n is a, c, g, or t
  misc_feature (1234)..(1235): n is a, c, g, or t
  misc_feature (1238)..(1239): n is a, c, g, or t
  misc_feature (1249)..(1249): n is a, c, g, or t
  misc_feature (1251)..(1251): n is a, c, g, or t
  misc_feature (1254)..(1254): n is a, c, g, or t
  misc_feature (1267)..(1267): n is a, c, g, or t
attagagagaattactatgagaggatcgcatcaccatcaccatcacggatcctatttaggtgacactatagaatcgtcgacccacgcgtccggagcggtttgcacaatgtcggaaatggctgagttgtccgagctgtatgaagagagcagtgacctgcagatggatgtgatgcctggcgagggtgaccttccgcagatggaggtaggcagcgggagccgggagctatccctgcgtccctcccgcagcggggcccaacagctcgaggaggaaggcccaatggaggaggaggaggcccagccaatggcggcgccagaggggaaacggagccttgctaacgggcccaacgctggggagcagccaggccaggtggcgggcgcagacttcgagagcgaggacgagggcgaggaatttgatgactgggaggacgactacgactatcccgaagaggagcagctcagtggtgccggctacagagtatcagccgctcttgaagaagccgacaagatgtttctgagaacaagagaaccagccctggatggcgggtttcagatgcattatgagaagaccccgtttgatcagttagcttttatcgaagagcttttttcactgatggttgtcaatcgtctgaccgaagaactcggctgtgatgagattattgatagagagtagttagatgctgttaaaagaggaggaaactacttgaggagggacccaactttccgctatcttttgggttcattccaaatagttttgtgccattgaaaaacttgaccttcaaaaaaatttgtttttcagaatagaacacaataggacagtgactgcacagttgtgaaaaaggaagagaatcnttaaagaaaagaaaaaagattttaagaccgttgaaatcaattatcaagaacgtcctaaaacacctatggctttgactttgttattgatccaaatnattttccttgcattggggaaaatatctttnnatatttgtttgctgtaaanatggnttttgcaanaataantcntgaccaaaacaactgccnatacnaaaccccctgntactattttttatganaaaaantgttcccactaggacncntntntttgattnttngactgaaacttaaaaacttggaaaatntntttntgatntntcanccccattntcaaggntcntttncggnaaaaaanggngaanaacncaaattttttcccggggnttnntnttaaagggttccaaannccnnaatttttttnanttnttttttttttaanccctgtttttaaa

SEQ ID NO: 216 - DNA, 865 bp, Human
agagatactatgagaggacgcatcaccatcaccatcacggatcctatttaggtgacactatagaatcgtcgactctggaccttggctgtcactcagttataacggctgtgcgtggtacaaaacccaggatcccaggactccttcgagaactctgagagttactgaaggctgagaatacaaaactccgtatacctgctgataaacaaaaggttgtggaaaaagaagctgagacagagaggaaaaaggcagttatacaagcagagaagattgcacaagtggcaaaaattcggtttcagcagaaagtgatggaaaaagaaactgaaaagcgcatttctgaaatcgaagatgctgcattcctggcccgagagaaagcgaaagcagatgctgaatattatgctgcacacaaatatgccacctcaaacaagcacaagttgaccccggaatatctggaactcacatagtaccaggccgttgcttctaacagcctcatctctttcggcatgagcatccctagcatgttcgtggactcctcatgtgctttgacatattcagatattacgactggaagagaaagctcactcccctctaatgaggctcttgaaccctctggagagaacgtcatccacaacaaagagagcacaggttgatgcaagaggtggaaatgttctccatatcaggatgtgaccacaggcgttaagtgggaacaatcattatacggactcttcagatcactgagaattacacgtcatcctgtcagctctctgcgatagtcgtggtgctccctgatggaggaagagcagctgtcgacaccaatgtctttcagcacatctaacagcatcgattgctcatactacggctagcagac

SEQ ID NO: 217 - DNA, 856 bp, Human
  misc_feature (664)..(688): n is a, c, g, or t
  misc_feature (749)..(749): n is a, c, g, or t
  misc_feature (807)..(807): n is a, c, g, or t
agagatactatgagaggtcgcatcaccatcccatcacggatcctatttaggtgacactatagaatcgtcgactctggaccttggctgtcactcagttggctatggttccgagggcaggactatgggaggctgccctgtacggaaaagaagaagaaatggcagtaaagagggcaaccattattccacccagcccaaaaggaataagagaaaccctatctttcaggattctcaagatacagagttttcatggagtgataatgaaaggagcagcagccgcattaatatcccagagagagcaagtggaccagaaggcaacttaaaccagattgttactgaacccgatgcaaactttccccagttcttgcatgaggggtatgtaccatgccaaggtctttactcccatatcaaccagaccttgaaggaggctcacttcaacagcctgcagcagcgagggcaagctccaacatgatgaattaggacttccttattccaacctaaactgtgtttataaaagcaattgcatacacaccaaaaaaagtctattggtttttaagtctacattttaagtaacaagttaatgggcagttgtttaattggggttttacttcactgttgtacttttaaaggggctgtgaataaatgtttatgaaatttttaaaaaaannnnnnnnnnnnnnnnnnnnnnnnnaacaagcggccgctcctatagtgagtcgaattaagctaattacctgacctggaactctggntgatagatcagtaatgacctcgaactcatctggatggtcaaacgctcggtgccgcggncgtttttatggtgagatccagctagctggcgagatttcggactaggagc

SEQ ID NO: 218 - DNA, 823 bp, Human
  misc_feature (2)..(2): n is a, c, g, or t
  misc_feature (803)..(803): n is a, c, g, or t
gngaattaactatgagaggatcgcatcaccatcaccatcacggatcctatttaggtgacactatagaatcgtcgacccacgcgtccgcaaaaaaaaactggaatcatgtggtagatgcaagggctggacccagtctaaagactacattgaaaccaaagaaagtgaaaactctatctgggaacaggataaaaagcaaccagatcagtaaactgcagaaggaatttaaacgtcataattctgatgctcacagtaccacctcaagtgcctccccagctcaatctccttgttacagtaaccagtcagatgacggctcagatacagagatggcttctggttctaacagaacaccagttttttcctttttagatctcacttactggaaaagacagaagatatgttgtgggatcatctataaaggccgttttggggaagtcctcattgacacacatctcttcaagccttgctgcagcaataagaaagcagctgctgagaagccagaggagcaggggccagagcctctgcccatctccactcaggagtggtgactgaggtttttatgtagaaggggaacaaaaaaaaaaatatctgaattttgaaaaaccacaaagctacaaactgaccctcttttttttttgagacggagttttgctcttgttacccaggctggagtgcagtggcgtgatcttggctcactgcaacttccgtctcccgggttcaggtgattctcctgcctcagcctcccaagtagctgggtttataggtgcccgccaccagacccggcttatttttttagttttagaaanagacggggtttcaccacgtt

SEQ ID NO: 219 - DNA, 950 bp, Human
atgagaggtcgcatcaccatcaccatcacggatcctatttaggtgacactatagaatcgtcgacccacgcgtccgggcaactcacgctccggaaactgcaggagctgtcctcaaaggcggatgaggccagcgagctggcatgccccacgcccaaggaggatggtctggcccagcagcagactcagctgaacctgcgctccctgctggtgaacccggagggccccaccctgatgcggctcaactccgtgcagagctcggagcggcccctgttcctggtgcacccaatcgagggctccaccaccgtgttccacagcctggcctcccggctcagcatccccacctatggcctgcagtgcacccgagctgcgccccttgacagcatccacagcctggctgcctactacatcgactgcatcaggcaggtgcagcccgagggcccctaccgcgtggccggctactcctacggggcctgcgtggcctttgaaatgtgctcccagctgcaggcccagcagagcccagcccccacccacaacagcctcttcctgttcgacggctcgcccacctacgtactggcctacacccagagctaccgggcaaagctgaccccaggctgtgaggctgaggctgagacggaggccatatgcttcttcgtgcagcagttcacggacatggagcacaacagggtgctggaggcgctgctgccgctgaagggcctagaggagcgtgtggcagccgccgtggacctgatcatcaagagccaccagggcctggaccgccaggagctgagctttgcggcccggtccttctactacaagctgcgtgccgctgagcagtacacacccaaggccaagtaccatggcaacgtgatgctactgcgcgccaagacgggtggcgcctacggcgaggacctggcgcggactacaacctctcccaggtatgcgacgggaaag

SEQ ID NO: 220 - DNA, 1083 bp, Human
caggttgataccaccaaagcagttattaccctgcagcctccgtgggttagcgtttttcaagaagaaaccgttacactgcattgcgaagttctgcatctgcctggtagcagcagcacccagtggtttctgaatggcaccgcaacccagaccagcaccccgagctatcgtattaccagcgcaagcgttaatgatagcggtgaatatcgttgtcagcgtggtctgagcggtcgtagcgatccgattcagctggaaattcatcgtggttggctgctgctgcaggttagcagccgtgtttttaccgaaggtgaaccgctggcactgcgttgtcatgcatggaaagataaactggtttacaacgtgctgtattatcgcaatggcaaagcctttaaattcttccattggaatagcaacctgaccatcctgaaaaccaatattagccataatggcacctatcattgtagcggtatgggtaaacatcgttataccagtgcaggtattagcgttaccgttaaagaactgtttccggcaccggttctgaatgccagcgttaccagtccgctgctggaaggtaatctggttaccctgagctgtgaaaccaaactgctgctgcaacgtccgggtctgcagctgtattttagcttttatatgggtagcaaaaccctgcgtggtcgtaataccagcagcgaatatcagattctgaccgcacgtcgtgaagatagcggtctgtattggtgtgaagcagcaaccgaagatggtaatgttctgaaacgtagtccggaactggaactgcaggttctgggcctgcagctgccgacaccgggtccgggtccgaccattcgcaaagaactgaaacgcaaaaaaaaatgggatctggaaattagcctggacagcggtcatgaaaaaaaagttattagcagcctgcaagaagatcgtcatctggaagaggaactgaaatgtcaagaacagaaagaagaacagctgcaagagggtgttcatcgtaaagaaccgcagggtgcaaccagatcttaagcggccgcggtacctcttaattaactggcctcatgggccttccgctcactgccc

SEQ ID NO: 221 - DNA, 1179 bp, Human
  misc_feature (913)..(913): n is a, c, g, or t
  misc_feature (951)..(951): n is a, c, g, or t
  misc_feature (954)..(954): n is a, c, g, or t
  misc_feature (965)..(965): n is a, c, g, or t
  misc_feature (977)..(977): n is a, c, g, or t
  misc_feature (987)..(987): n is a, c, g, or t
  misc_feature (1006)..(1006): n is a, c, g, or t
  misc_feature (1036)..(1036): n is a, c, g, or t
  misc_feature (1049)..(1049): n is a, c, g, or t
  misc_feature (1059)..(1059): n is a, c, g, or t
  misc_feature (1078)..(1078): n is a, c, g, or t
  misc_feature (1081)..(1081): n is a, c, g, or t
  misc_feature (1085)..(1085): n is a, c, g, or t
  misc_feature (1089)..(1089): n is a, c, g, or t
  misc_feature (1098)..(1098): n is a, c, g, or t
  misc_feature (1106)..(1106): n is a, c, g, or t
  misc_feature (1123)..(1123): n is a, c, g, or t
  misc_feature (1126)..(1126): n is a, c, g, or t
  misc_feature (1138)..(1138): n is a, c, g, or t
  misc_feature (1140)..(1140): n is a, c, g, or t
  misc_feature (1145)..(1146): n is a, c, g, or t
  misc_feature (1149)..(1149): n is a, c, g, or t
  misc_feature (1155)..(1155): n is a, c, g, or t
  misc_feature (1167)..(1167): n is a, c, g, or t
  misc_feature (1172)..(1172): n is a, c, g, or t
  misc_feature (1175)..(1176): n is a, c, g, or t
  misc_feature (1178)..(1178): n is a, c, g, or t
aattagagaaattactatgagaggatcgcatcaccatcaccatcacggatcctatttaggtgacactatagaatcgtcgacccacgcgtccgggaaaggggactcagaagctgaggcactctcagagataaaagatggttcccttccacccgaactgtcttgcatcccatcccacagagttctagggcccccgacttcaattccacctgagcccctaggccctgtatccatggactctgagtgtgaggagtcacttgctgccagcccaatggcagctaagcccgacaacccatcaggaaaggtctgtgtcagggaagtagcaccagatggcccactacaagaaagctccacaagactgtccctgacctcagaccccgaggagggggacccactggccttagggcctgaaagcccaggagagcctcagcctccacagctcaagaaagatgatgtcactagctccaccggtccccacaaggagctgtcaagcacagaggcaggttccacagttgcaggagcagccctcagacccagccatcattcccagcgttccagtctctctggggatgaagaggatgaactgtttaaaggggcaactctgaaagctctgaggcccaaagcacagcctgaggaggaggatgaagacgaggtgagcatgaagggacgcccgcccccaacgcccctttttggagatgatgatgatgacgatgacattgactggctgggatgaagacccaggaaactggtgcaaaggtttctctgcaacccttccctaagcatgattttgcacagccaaccctgggtctaggcgagccacagggtgaggtcaaggtgagcattctgggaacaatatttgggctcagagggtgggttggccaccttctgagccccacccccgccagacctggtgaanaggatcataaccctgtcttcaaaacactgggatttcancancaagttggaanaaggactggtangttccctccnagccagtcacctgtaaaantcctgtcctctgccaaatttttaatctctncataactcccaantgactggganccctctctacttgaatccntgntcantggncccggcaanaaactggntgagtttcctggtaaantanggaattaccctntnatccnnggntcaaanctggctaaatcnggaanganntnt

SEQ ID NO: 222 - DNA, 1065 bp, Human
  misc_feature (804)..(804): n is a, c, g, or t
  misc_feature (844)..(844): n is a, c, g, or t
  misc_feature (885)..(885): n is a, c, g, or t
  misc_feature (888)..(888): n is a, c, g, or t
  misc_feature (904)..(904): n is a, c, g, or t
  misc_feature (914)..(914): n is a, c, g, or t
  misc_feature (921)..(921): n is a, c, g, or t
  misc_feature (935)..(935): n is a, c, g, or t
  misc_feature (940)..(940): n is a, c, g, or t
  misc_feature (954)..(954): n is a, c, g, or t
  misc_feature (963)..(963): n is a, c, g, or t
  misc_feature (984)..(984): n is a, c, g, or t
  misc_feature (991)..(991): n is a, c, g, or t
  misc_feature (1006)..(1006): n is a, c, g, or t
  misc_feature (1028)..(1029): n is a, c, g, or t
  misc_feature (1033)..(1035): n is a, c, g, or t
  misc_feature (1043)..(1043): n is a, c, g, or t
  misc_feature (1045)..(1045): n is a, c, g, or t
  misc_feature (1047)..(1048): n is a, c, g, or t
  misc_feature (1050)..(1050): n is a, c, g, or t
  misc_feature (1055)..(1055): n is a, c, g, or t
  misc_feature (1060)..(1060): n is a, c, g, or t
  misc_feature (1064)..(1064): n is a, c, g, or t
aatagagaaattaactatgagaggatcgcatcaccatcaccattcacggatcctatttaggtgacactatagaatcgtcgacccacgcgtccgtggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagacggccatggtcactgctgactccaagtactgctacggcccccaaggcaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgaggccatccccatcctgaagncagccctgaagctggaaccttccaacaaagacgatccacncagaagctctcaaagcttggtgaaaaagcatgcggcgcaancgnaacacgaaaaccgccnttgttaccgnaaaaatnttgggcaaacccanccggntgccttgctaaatnccccttggnaagggtgcctggtccatcccnatgaaantggctgtttggggcnaatgctttttgccttggggggnntggnnntctcttgngntnntnccttnccaanaaant

SEQ ID NO: 223 - DNA, 1390 bp, Human
  misc_feature (9)..(9): n is a, c, g, or t
ggcgccccnctaggaattcttgagaggatgcatcaccatcaccatcacggtcgacccacgcgtccggcggagcgggaggccggaccggggagccgagcggcggcgtcggcggcgtcggcggcggcggcgacggcggcgggggcggtaatggcggagctggtgcaggggcagagcgctcctgtggggatgaaggccgagggcttcgtggatgccctgcaccgggtccggcagattgctgctaaaattgattcaattcctcacttgaataattccacacctctagtggacccctcagtatatggatacggagtacaaaaacggcccttggatgatggagtaggtaaccagttaggggccttggtacatcaaaggacggtaataacggaagaattcaaagtgcctgacaaaatggttggatttattatcggcaggggaggtgagcagatttcacggattcaagcagaatctggttgcaaaattcagattgcttcagagagttctgggattccagagaggccctgtgtacttaccggaaccccagaaagtattgaacaagccaaacggctcctgggacagattgtggaccgctgtcgaaatggacctggctttcataatgacatagacagcaacagcacaatccaggagattctcattcccgcatctaaagtgggtctggtcatcggcagaggaggggaaacaatcaagcagttgcaggagcggacaggggtgaagatggtcatgatccaagatggcccattgcccacgggagcagacaagccctctcgtatcactggagatgccatttaagtacagcaagcaagagaaatggtcctagagattatccgagaaaaagaccagctgacttttccgggggaccccgggatttccacccccaaagggaaggaggcctataaaaggatctgtccctaggtttccctgggggaatgcaccaaaaaaaaccgggaattgtcccaacaacccccacggccccggggggccgcatccctcaaccccactgacggccttacccccaaagcctgcccgccccgggtccccccaaccgcgttccatgccccaatctcaccccagggttttctacccccaacacacaaacttttagacccccaccgccacaaaaacaaccgccgccccgccccacacctcgtacccccttcgcccccacaaactcactcctcctccacacggtcctcttttcgctcaccagacctcactaccaaccccctccggcccctaccaccctcacccccccccccaccacccccatatcccccggccccctaatgctcgccccctccaaccatctatcacactcatccccactctctcctcaactcccccactcacacacctcactcccgctcgatcttta

SEQ ID NO: 224 - DNA, 815 bp, Human
  misc_feature (2)..(2): n is a, c, g, or t
  misc_feature (770)..(770): n is a, c, g, or t
  misc_feature (777)..(777): n is a, c, g, or t
  misc_feature (802)..(802): n is a, c, g, or t
tnagaggagaattaactatgagaggatcgcatcaccatcaccatcacggatcctatttaggtgacactatagaatcgtcgacccacgcgtccgcccacgcgtccgtggagcggcagcagcagcagcaacagcaactgagaaacctgcgtgacttcctgttggtctacaatcggatgacagaactctgcttccagcgctgtgtgcccagcttgcaccaccgagctctggacgctgaggaggaggcctgtctgcacagctgtgctgggaagctgatccattccaaccaccgcctcatggccgcttacgtgcagctcatgcctgccctggtacagcgccgcatcgcagactacgaggctgcctcggctgtgccaggcgttgctgctgaacagcctggggtctctccatcaggcagctagccatacccaaccccaggaaggaaggccttggacggaccctcagattgaaggacccggtggaccttggggttggtgaatcctaaacagagagaattcgaggttgcctgaaagctgggtgtccttactccttttcctggagccaatatacccagtttttactcagtttgatttatattctgggcaaggaagctttgcctactttattggcacaatccgttgttctgtcgtttagtgcatatctgctggcttcagccctggcagctgagaaattgttttctatatgtagaaggaaaacctgagcatttgcaggcatctggttaaagcagggtctgtgtgtacaattttaaaacgggnaatatgncatgctcttagttcatcttcacaanaaaactatgagta

SEQ ID NO: 225 - DNA, 898 bp, Human
  misc_feature (734)..(736): n is a, c, g, or t
  misc_feature (762)..(762): n is a, c, g, or t
  misc_feature (793)..(793): n is a, c, g, or t
  misc_feature (822)..(822): n is a, c, g, or t
  misc_feature (828)..(828): n is a, c, g, or t
  misc_feature (835)..(835): n is a, c, g, or t
  misc_feature (845)..(846): n is a, c, g, or t
  misc_feature (853)..(853): n is a, c, g, or t
  misc_feature (858)..(859): n is a, c, g, or t
  misc_feature (873)..(875): n is a, c, g, or t
  misc_feature (881)..(882): n is a, c, g, or t
  misc_feature (886)..(886): n is a, c, g, or t
  misc_feature (888)..(888): n is a, c, g, or t
gaggaattactatgagaggtcgcatcccatcaccatcacggatcctatttaggtgacactatagaatcgtcgactctggaccttggctgtcactcagtttagccgtcggcaggtcccaggcgcgaagtttctcggcctggaggagggggtcgcgcgaagtgccagatgcaggcggggaagcccatcctctattcctatttccgaagctcctgctcatggagagttcgaattgctctggccttgaaaggcatcgactacaagacggtgcccatcaatctcataaaggatgggggccaacagttttctaaggacttccaggcactgaatcctatgaagcaggtgccaaccctgaagattgatggaatcaccattcaccagtcactggccatcattgagtatctagaggagacgcgtcccactccgcgacttctgcctcaggacccaaagaagagggccagcgtgcgtatgatttctgacctcatcgctggtggcatccagcccctgcagaacctgtctgtcctgaagcaagtgggagaggagatgcagctgacctgggcccagaacgccatcacttgtggctttaacgccctggagcagatcctacagagcacagcgggcatatactgtgtaggagacgaggtgaccatggctgatctgtgcttggtgcctcaggtggcaaatgctgaaagattcaaggtggatctcaccccctaccctaccatcagctccatcannncagagctgctggtcttggaggccttncaggtgtctcacccctgccgggcagcagatnacaccactgagctgagggcctagctcccnaatccntgcccgntggcacaggnncacagancaaannctgggtgggctgannnagctgnnaacnanagtctattga

SEQ ID NO: 226 - DNA, 784 bp, Human
  misc_feature (686)..(686): n is a, c, g, or t
  misc_feature (747)..(747): n is a, c, g, or t
ccaaccaataaaaaaatactatgagaggatgcatcccatcaccatcacggatcctatttaggtgacactatagaatcgtcgactctggaccttggctgtcactcagttagaggcggagtcggcgccgagaacatggctggaggcaaagctggaaaggacagtgggagggccaaggctaaggcagtatctcgctcacagagagctgggctacagtttcctgtgggccgcatccacagacacttgaagactcgcaccacaagccatggaagggtgggtgccactgctgccgtgtacagtgctgcgattctggagtacctcactgcagaggtgctggagctggcaggtaatgcttctaaggatctcaaagtaaagcgtatcactccgcgtcacttgcagcttgcaatccgtggtgatgaagagttggattctcttatcaaggctaccatagctgggggtggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcatagacaattactgtagacatgataaaagaaacatttgtatgttcttagactcgaagtttngataaagtaccttttcatgtggtgacagttgtgtgttgattggctaggtttctcccgtgtngtttatacaaaaatggaattgataaaccattttttac

SEQ ID NO: 227 - DNA, 963 bp, Human
atgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaa

SEQ ID NO: 228 - DNA, 1157 bp, Human
  misc_feature (943)..(943): n is a, c, g, or t
  misc_feature (954)..(954): n is a, c, g, or t
  misc_feature (956)..(956): n is a, c, g, or t
  misc_feature (997)..(997): n is a, c, g, or t
  misc_feature (1006)..(1007): n is a, c, g, or t
  misc_feature (1019)..(1019): n is a, c, g, or t
  misc_feature (1027)..(1027): n is a, c, g, or t
  misc_feature (1041)..(1041): n is a, c, g, or t
  misc_feature (1066)..(1066): n is a, c, g, or t
  misc_feature (1078)..(1078): n is a, c, g, or t
  misc_feature (1090)..(1090): n is a, c, g, or t
  misc_feature (1100)..(1100): n is a, c, g, or t
  misc_feature (1117)..(1117): n is a, c, g, or t
  misc_feature (1126)..(1126): n is a, c, g, or t
  misc_feature (1128)..(1128): n is a, c, g, or t
  misc_feature (1136)..(1137): n is a, c, g, or t
  misc_feature (1145)..(1145): n is a, c, g, or t
  misc_feature (1151)..(1151): n is a, c, g, or t
aatagagaaattactatgagaggatcgcatcaccatcaccatcacggatcctatttaggtgacactatagaatcgtcgacccacgcgtccgcccacgcgtccggtcatcataaagtttctgtttcacccgtcgtccatgttcgaggactctgtgaatctgtggtggaagcagacctcgtggaagcgctggaaaaatttgggacaatatgctatgtgatgatgatgccatttaaacgacaggctctagtggaatttgaaaacatagatagtgccaaagaatgtgtgacatttgctgcagatgaacccgtgtacattgctggtcaacaggcttttttcaactattctacaagcaaaaggatcactcggccaggaaatactgatgatccatcaggaggcaacaaagttcttctgctctcaattcagaatccgctttatccaattacagtggatgttttatatactgtatgcaaccctgttggcaaagtgcaacgtattgttatattcaagagaaatgggatacaagcaatggttgagtttgaatcagtcctttgtgcccagaaagctaaagcagcactcaatggagctgatatatatgctggatgttgcacactaaaaattgaatatgcacggccaactcgtctaaatgttattaggaatgacaatgacagttgggactacactaaaccatatttgggaagacgagatagaggaaagggtcgccagagacaagccattttgggagaacacccttcttcgtttagacatgatggctatggatcccatggtccattattgcctttaccaagtcgttacagaatgggctctcgagatacacctgaacttgttgcttatccattaccacaggcttcttcctcttacatgcatggaggaaatcccctctggttcagttgtaatggttagtggattacatcaactaaaatgnaattgttcaanantcttccacctggttctgcttatatggaaatattgaaaaggntaaaatttnngaaaaccattcntggtacancccttggtaaaaanggggtgaagaatatgctgtaaaaanacttgtcccccnccttaaaaatgnccaattattngggaaaaaacttaatgnttggcgggntnaaaaaaannttcagttnttccangtcaaa

SEQ ID NO: 229 - DNA, 676 bp, Human
agagatactatgagaggtcgcatcaccatcaccatcacggatcctatttaggtgacactatagaatcgtcgactctggaccttggctgtcactcagttatggacgtgcggggccctgaagcccccggcgggcgcgcgctgcgggacgcggcagaaaatctatttcaggaacttcaggaacattttcaagctctgacggcaacattaaacctcagaatggaagaaatgggaaatcgcattgaggacttacagaagaatgtcaatgacttaatggtgcaagctggcattgaaaattctattaaagaacaaatgctgaagacctaactgcagcatgtctgtatttggagatggggcctctacagaagtcattaaggttacatcggtcctgagggtggggccctcatccaacaggattcgtctttctgagaagagacgcaaggggctcgcctgctctccccccgtgcctgcaccagagaaggaggccatcggcaagccaaggagagccctccccagaaatcacacggaccagcaccttgatctgggacttccagaaaacagaactgtgaaaagacaagtttctgttgtttaaaccacccaatctgaagtattttgttatggcagtcctgggcagactaatacaatatgcaacacatttacaataaatatacaataaactt

SEQ ID NO: 230 - DNA, 1346 bp, Human
  misc_feature (1)..(1): n is a, c, g, or t
  misc_feature (12)..(14): n is a, c, g, or t
  misc_feature (699)..(699): n is a, c, g, or t
ncccatttctcnnntgaggaatactagagaggatgcatcaccatcaccatcacggtcgacccacgcgtccgtggagccaggcctacaccccagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggttggagcagaaagaaacgtgctcatctttgacctgngaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgaaccctctcttccagcacccgggcaggtattgagaaccattctctctattgaagaatcgacttctatacctcccatacccgtgcccgaattgaaaaactgaatgctgacctgttccgtggcaccctggaaccagtaaaaaaagcccttccaaaagccaactaaaacaaccccaaatccatgaattgccccgggttggggggctcccatccaaccccaaaatttaaaagtttccccaaaaatttttcattggaaaaaaatcgataaaaactccacccccaataaaccgtttcttatgggcaaccttccaacacccctatttttcggaaacaatcttgaaaattttccaaaatcggcctcttggagacccccccccttcccaccgaataaaacgcgcgtgccacaccatcatcctaccaaacctaaaaaacatcc

SEQ ID NO: 231 - DNA, 709 bp, Human
  misc_feature (7)..(10): n is a, c, g, or t
aggcccnnnnttgagagatactagagaggatcgcatcaccatcaccatcacggtcgacccacgcgtccgggtagttactatggaaacccagctgccatcgctatgtctctgcaaaagacccctccgacccgagtgttcgtggaactggttccctgggctgaccggagccgggagaacaacctggcctcagggagagagacgctaccgggcttacgccaccccctctcctcaacacaagcccaaactgctacccgcgaggtgcaagtaagcggcacctcagaagtgtctgcgggccctgaccgggcgcaggtggtggtgcgagtgagcagcaccaaggaggcggcagccgaggccaaaaagagcgtttgtcgccgtctagattacatcacgcagagcctccagcagcagggcgtgcaggcagaaaatataactgtgacaaaggattttaggagagtggaaaatgcttatcacatggaagcagaggtctgcattacatttactgaatttggaaaaatgcaaaatatttgtaactttcttgttgaaaagctagatagctctgttgtcatcagcccaccccagttctatcatactccaggttctgttgagaatcttccaccgcaagcccgtcttgttgctgttgaaaatgcctggcgcaaagctcagaaatctgtaacccttgtgggcaaaccctaggaaaaccttacttatc

SEQ ID NO: 232 - DNA, 1794 bp, Human
atggcggccgtgcaggcggccgaggtgaaagtggatggcagcgagccgaaactgagcaagaatgagctgaagagacgcctgaaagctgagaagaaagtagcagagaaggaggccaaacagaaggagctcagtgagaaacagctaagccaagccactgctgctgccaccaaccacaccactgataatggtgtgggtcctgaggaagagagcgtggacccaaatcaatactacaaaatccgcagtcaagcaattcatcagctgaaggtcaatggggaagacccatacccacacaagttccatgtagacatctcactcactgacttcatccaaaaatatagtcacctgcagcctggggatcacctgactgacatcaccttaaaggtggcaggtaggatccatgccaaaagagcttctgggggaaagctcatcttctatgatcttcgaggagagggggtgaagttgcaagtcatggccaattccagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggaaacaaggtatcgccagagatacttggacttgatcctgaatgactttgtgaggcagaaatttatcatccgctctaagatcatcacatatataagaagtttcttagatgagctgggattcctagagattgaaactcccatgatgaacatcatcccagggggagccgtggccaagcctttcatcacttatcacaacgagctggacatgaacttatatatgagaattgctccagaactctatcataagatgcttgtggttggtggcatcgaccgggtttatgaaattggacgccagttccggaatgaggggattgatttgacgcacaatcctgagttcaccacctgtgagttctacatggcctatgcagactatcacgatctcatggaaatcacggagaagatggtttcagggatggtgaagcatattacaggcagttacaaggtcacctaccacccagatggcccagagggccaagcctacgatgttgacttcaccccacccttccggcgaatcaacatggtagaagagcttgagaaagccctggggatgaagctgccagaaacgaacctctttgaaactgaagaaactcgcaaaattcttgatgatatctgtgtggcaaaagctgttgaatgccctccacctcggaccacagccaggctccttgacaagcttgttggggagttcctggaagtgacttgcatcaatcctacattcatctgtgatcacccacagataatgagccctttggctaaatggcaccgctctaaagagggtctgactgagcgctttgagctgtttgtcatgaagaaagagatatgcaatgcgtatactgagctgaatgatcccatgcggcagcggcagctttttgaagaacaggccaaggccaaggctgcaggtgatgatgaggccatgttcatagatgaaaacttctgtactgccctggaatatgggctgccccccacagctggctggggcatgggcattgatcgagtcgccatgtttctcacggactccaacaacatcaaggaagtacttctgtttcctgccatgaaacccgaagacaagaaggagaatgtagcaaccactgatacactggaaagcacaacagttggcacttctgtctag

SEQ ID NO: 233 - DNA, 868 bp, Human
actatgagaggtcgcatcaccatcaccatcacggtcgacccacgcgtccgcccacgcgtccgctcatcaagcagatcgggaagaaggccatgaagacaagcgggggtggggagacgggcccgggcccagggctggggcctcaaggcggtgggctcccagcactgcccccttccctggtgcccctggtagtctactccaagaaccgggtgcccaccttggaagaggtgtcacagacactgaggagcaaaggccacgtatcaaggtccccagatgaggaggctgtggcacgggcccctgaagacagctcccctgcccccgaggtgttcatgaaccagctggaccgcatcagcgaggaatgcgagccatgggacgcccaggactaccacccactcatcttccaggacgccagcatcaccttcgtgaacacggaggctggcctctcagacgaggagacctccaagtcctcgctagaggacaacttggcaggggaggagagcccccagcagggggctgaagccaaggcgcccctgaacatgggcgagttcccctcctcctccgagtccaccttcaccagcactgagtctgagctctctgtgccttacgaacagctgatgaatgagtacaacaaggctaacagccccaagggcacatgaggcagggccggctccccaccccacctttgatggcctcttcccccctcaccctagggtgtcccgagatgaccgggacgcctggcccctggtgggggggcagcctcggaactgggagtggggggcccaggggccttcctaaccttccatcatcctcaactagatgtatgcccgggacagggcctctgttctccagctgaaccataccctggctgtgg

SEQ ID NO: 234 - DNA, 1284 bp, Human
  misc_feature (830)..(830): n is a, c, g, or t
  misc_feature (902)..(902): n is a, c, g, or t
  misc_feature (912)..(912): n is a, c, g, or t
  misc_feature (948)..(948): n is a, c, g, or t
  misc_feature (963)..(963): n is a, c, g, or t
  misc_feature (968)..(968): n is a, c, g, or t
  misc_feature (980)..(980): n is a, c, g, or t
  misc_feature (987)..(988): n is a, c, g, or t
  misc_feature (996)..(996): n is a, c, g, or t
  misc_feature (1005)..(1005): n is a, c, g, or t
  misc_feature (1020)..(1020): n is a, c, g, or t
  misc_feature (1034)..(1034): n is a, c, g, or t
  misc_feature (1043)..(1043): n is a, c, g, or t
  misc_feature (1050)..(1050): n is a, c, g, or t
  misc_feature (1055)..(1055): n is a, c, g, or t
  misc_feature (1062)..(1062): n is a, c, g, or t
  misc_feature (1077)..(1078): n is a, c, g, or t
  misc_feature (1081)..(1081): n is a, c, g, or t
  misc_feature (1087)..(1087): n is a, c, g, or t
  misc_feature (1090)..(1090): n is a, c, g, or t
  misc_feature (1098)..(1098): n is a, c, g, or t
  misc_feature (1117)..(1117): n is a, c, g, or t
  misc_feature (1125)..(1125): n is a, c, g, or t
  misc_feature (1130)..(1130): n is a, c, g, or t
  misc_feature (1136)..(1136): n is a, c, g, or t
  misc_feature (1139)..(1139): n is a, c, g, or t
  misc_feature (1154)..(1154): n is a, c, g, or t
  misc_feature (1162)..(1162): n is a, c, g, or t
  misc_feature (1168)..(1169): n is a, c, g, or t
  misc_feature (1173)..(1173): n is a, c, g, or t
  misc_feature (1181)..(1181): n is a, c, g, or t
  misc_feature (1188)..(1188): n is a, c, g, or t
  misc_feature (1193)..(1193): n is a, c, g, or t
  misc_feature (1197)..(1197): n is a, c, g, or t
  misc_feature (1199)..(1199): n is a, c, g, or t
  misc_feature (1203)..(1203): n is a, c, g, or t
  misc_feature (1212)..(1212): n is a, c, g, or t
  misc_feature (1216)..(1216): n is a, c, g, or t
  misc_feature (1223)..(1223): n is a, c, g, or t
  misc_feature (1226)..(1226): n is a, c, g, or t
  misc_feature (1235)..(1235): n is a, c, g, or t
  misc_feature (1240)..(1241): n is a, c, g, or t
  misc_feature (1261)..(1261): n is a, c, g, or t
  misc_feature (1269)..(1269): n is a, c, g, or t
  misc_feature (1271)..(1271): n is a, c, g, or t
  misc_feature (1274)..(1274): n is a, c, g, or t
  misc_feature (1278)..(1278): n is a, c, g, or t
  misc_feature (1280)..(1281): n is a, c, g, or t
tagagaaattactatgagaggatcgcatcaccatcaccatcacggatcctatttaggtgacactatagaatcgtcgacccacgcgtccggtcaccctaaagaagtgataaatgttgaaagtgatggatatggtaattaccccagtttcatcattatactatgtatacatgcattgaaacatcacattgtaccccataaatatgtacaattattatgtgtcaactataaataaaatttttttaaaaagaattggcccgtgggttttctccattacagatttattgccaaaccctgtgcactccgtattggcatcgaggacagtggtccttatcaggcccaacccaatgccatccttgaaaaggtgttcatatctattaccaagtatcctgataagaaaaggctggagggcctgtcaaagcagctggattggaatgtccgaaaaatccaatgctggtttcgccatcggaggaatcaggacaagcccccaacgcttactaaattctgtgaaagcatgtggagattcacattttatttatgtatattctgctatggaattagatttctctggtcgtcaccttggttctgggacatccgacagtgctggcataactatccatttcagcctctttcaagtgggctttatcactattatatcatggaattggccttctattggtcccttatgttttctcagtttacagacattaaaagaaaggacttcctgatcatgtttgtgcatcacttggtcaccattgggcttatctccttctcctacatcaacaatatggttcgagtgggaactctgatcatgtgtctacatgatgtctcanacttcttgctggaggcagccaaactgggccaattatgccaagtatcagcggctctgtgacacccctttttgngatcttcagngctgtttttatggttacccgactaggaatctatccnttctgggaaagtggnaaggnctgtaaagttgnggtaagnntgaacccnaagaaaccnttttgccaattcccnattttgcccaatcnagttttccnggtccantccanttccaanttccccaaaaaaacnnaanaaaccnaantgcccggntttaccttaacccggggcngaccctcnggggnaccccnaangaacccccgccgccncaaaacgnattttnnacanggccgganccaaacncaaanaccngnttgntggctcccngaangaacccnccnggagaaaanccccnntttagcccaaaaattccttnatcctttncnggngaanannccc

SEQ ID NO: 235 - DNA, 963 bp, Human
tgagaggatcgcatcaccatcaccatcacggatcctatttaggtgacactatagaatcgtcgacccacgcgtccgcaggccctgggcccgtcctcgtcaggctcatctcctatgacctgcgtgaaggacaggacagtgaggagctcagcagcctgataaagtccaacggccaacggagcctggagctgtggccgcgcccccagcaggcaccccgctcgcggtccctgatagtgcacttccacggcggtggctttgtggcccagacctccagatcccacgagccctacctcaagagctgggcccaggagctgggcgcccccatcatctccatcgactactccctggcccctgaggcccccttcccccgtgcgctggaggagtgcttcttcgcctactgctgggccatcaagcactgcgccctccttggctcaacaggggaacgaatctgccttgcgggggacagtgcaggcgggaacctctgcttcaccgtggctcttcgggcagcagcctacggggtgcgggtgccagatggcatcatggcagcctacccggccacaatgctgcagcctgccgcctctccctcccgcctgctgagcctcatggaccccttgctgcccctcagtgtgctctccaagtgtgtcagcgcctatgctggtgcaaagacggaggaccactccaactcagaccagaaagccctcggcatgatggggctggtgcggcgggacacagccctgctcctccgagacttccgcctgggtgcctcctcatggctcaactccttcctggagttaagtgggcgcaagtcccagaagatgtcggagcccatagcagagccgatgcgccgcagtgtgtctgaagcagcactggcccagccccagggcccactgggcacggattcctcaagaacctgaccctgagggacttgagcctgaggggaaactccgagacgtcgtcggacacccc

SEQ ID NO: 236 - DNA, 627 bp, Human
  misc_feature (621)..(621): n is a, c, g, or t
  misc_feature (625)..(627): n is a, c, g, or t
cccccaggatagagagatactatgagaggtcgcatcaccatcaccatcacggatcctatttaggtgacactatagaatcgtcgactctggaccttggctgtcactcagttgggggcggggcctgctcgagtgaggccgggagcggaccgcagcccgctggaggtgccgggggcgaaatgctggcgtctgctccttcgtctcccagaatcctgccctggaaaaaaccagcgccaaccgccggtttaactgaggacggatttaaggcattacgaaagacagctttcccctttgctcggctctccttctctctcctgctgccctgtgaagaggtgacttctgccataattgaagaggaagacagagctcttaccagggggaggcagagatggcacagcaagagacatgcccccagaatgccaccaatgccccaggacaggcccacccatgggaccaggttatcgggataacctgggaggatggggtggaatctgaggggtgagccttcttccccaggctggaagtgggcgacacgagactggcacctctacatctgattgtcccccaaacccagcatttatgtcgtgagcaaagaaagaaatcatgttacttcttccaaaaaanaaannn

SEQ ID NO: 237 - DNA, 629 bp, Human
agaggatcgcatcaccatcaccatcacggtcgacccacgcgtccggtaagaaaggacggaggctgttatctatggcagatctatccaataaaggagagaaaggaccgcatacgcctggttctcatcatatgcaataaagagtttgaccatctgcctccaagaaatggggctgactttgccatcatggagatgaagaagctgcttgaggatctgggttacagtgtggatgtagaagagaatctgacagccaggataacgtgtccaggagagacagcacaaggggctccatcttcatcacacaactcatcgcatgcttccagagatattcctggcgctgccacctagaggaagtattttggaaggttcagcaagcatttgaaagtccggaggcaacagtccaaatgcccaccatagaacgagtgtccatgacaagatatttctacctctttcctggcaactgaaaatggttaagcattgagagttgttggtggtgtatgaaataaatgaaagtgtgatattggaggaaaccacaagcagcccagccctcctttatcaacttcaagaaacacctttactagtacagattgaatgcttaacattttgtatttcaataaaggtgaagacaaatg

SEQ ID NO: 238 - DNA, 764 bp, Human
  misc_feature (2)..(2): n is a, c, g, or t
  misc_feature (4)..(7): n is a, c, g, or t
  misc_feature (9)..(15): n is a, c, g, or t
  misc_feature (442)..(442): n is a, c, g, or t
  misc_feature (464)..(464): n is a, c, g, or t
  misc_feature (469)..(469): n is a, c, g, or t
  misc_feature (509)..(509): n is a, c, g, or t
  misc_feature (516)..(516): n is a, c, g, or t
  misc_feature (527)..(527): n is a, c, g, or t
  misc_feature (537)..(537): n is a, c, g, or t
  misc_feature (541)..(541): n is a, c, g, or t
  misc_feature (556)..(556): n is a, c, g, or t
  misc_feature (579)..(579): n is a, c, g, or t
  misc_feature (581)..(582): n is a, c, g, or t
  misc_feature (596)..(596): n is a, c, g, or t
  misc_feature (619)..(619): n is a, c, g, or t
  misc_feature (635)..(636): n is a, c, g, or t
  misc_feature (638)..(638): n is a, c, g, or t
  misc_feature (678)..(678): n is a, c, g, or t
  misc_feature (681)..(682): n is a, c, g, or t
  misc_feature (687)..(687): n is a, c, g, or t
  misc_feature (694)..(694): n is a, c, g, or t
  misc_feature (706)..(706): n is a, c, g, or t
  misc_feature (725)..(725): n is a, c, g, or t
  misc_feature (730)..(730): n is a, c, g, or t
  misc_feature (738)..(739): n is a, c, g, or t
  misc_feature (742)..(742): n is a, c, g, or t
  misc_feature (745)..(745): n is a, c, g, or t
  misc_feature (752)..(752): n is a, c, g, or t
  misc_feature (762)..(763): n is a, c, g, or t
gncnnnntnnnnnnnattattaagagagaattaactatgagaggatcgcatcaccatcaccatcacggatcctatttaggtgacactatagaatcgtcgacccacgcgtccggctcctcaggcaccccgtatctgggcagcaagatcagcctcatctccaaggcgcagatccgctacgagggcattctctacaccatcgacaccgacaactccaccgtggcgctcgccaaagtgaggtcctttggcactgaagaccgtcccacagataggcctgcgccccccagagaggagatttatgagtacatcattttccgaggaagtgacatcaaggatatcactgtgtgtgaacctccgaaagctcagcacacactcccgcaggatcccgccattgttcagtcttccctgggttctgcctccgcctcgcccttccagccgcacgtgncttacagcccctttccgagggnatggngcccctacggcccgttggccggccagctcccctgctcagncagcagntatgccgcctnccctggggtntagnagaagttggtaaagnccctccagcccttcagccggccngnntttccaggccctangctccttcctccaatctcccacnaggccccggtttccannangttttggacttttgttcccttccagaaaggccaacaaggnaannttttnacttggncccaaggggaangccttggttttttttccanttccnttcccccnnggntcnggtaaanaaagcccccnna

SEQ ID NO: 239 - DNA, 1252 bp, Human
  misc_feature (900)..(900): n is a, c, g, or t
  misc_feature (936)..(936): n is a, c, g, or t
  misc_feature (964)..(964): n is a, c, g, or t
  misc_feature (985)..(985): n is a, c, g, or t
  misc_feature (1014)..(1014): n is a, c, g, or t
  misc_feature (1016)..(1016): n is a, c, g, or t
  misc_feature (1023)..(1023): n is a, c, g, or t
  misc_feature (1032)..(1032): n is a, c, g, or t
  misc_feature (1036)..(1036): n is a, c, g, or t
  misc_feature (1045)..(1045): n is a, c, g, or t
  misc_feature (1075)..(1075): n is a, c, g, or t
  misc_feature (1077)..(1077): n is a, c, g, or t
  misc_feature (1084)..(1084): n is a, c, g, or t
  misc_feature (1091)..(1091): n is a, c, g, or t
  misc_feature (1093)..(1093): n is a, c, g, or t
  misc_feature (1095)..(1095): n is a, c, g, or t
  misc_feature (1101)..(1101): n is a, c, g, or t
  misc_feature (1103)..(1103): n is a, c, g, or t
  misc_feature (1111)..(1111): n is a, c, g, or t
  misc_feature (1113)..(1113): n is a, c, g, or t
  misc_feature (1124)..(1124): n is a, c, g, or t
  misc_feature (1126)..(1126): n is a, c, g, or t
  misc_feature (1130)..(1130): n is a, c, g, or t
  misc_feature (1132)..(1132): n is a, c, g, or t
  misc_feature (1139)..(1139): n is a, c, g, or t
  misc_feature (1149)..(1149): n is a, c, g, or t
  misc_feature (1151)..(1151): n is a, c, g, or t
  misc_feature (1155)..(1155): n is a, c, g, or t
  misc_feature (1158)..(1158): n is a, c, g, or t
  misc_feature (1170)..(1170): n is a, c, g, or t
  misc_feature (1208)..(1208): n is a, c, g, or t
  misc_feature (1213)..(1213): n is a, c, g, or t
  misc_feature (1219)..(1219): n is a, c, g, or t
  misc_feature (1225)..(1225): n is a, c, g, or t
  misc_feature (1239)..(1240): n is a, c, g, or t
  misc_feature (1243)..(1243): n is a, c, g, or t
  misc_feature (1245)..(1245): n is a, c, g, or t
  misc_feature (1252)..(1252): n is a, c, g, or t
attagagaaattactatgagaggatcgcatcaccatcaccatcacggatcctatttaggtgacactatagaatcgtcgacccacgcgtccgctcccctcctcaattcaggagctggttttccatccatcccagtcggcaagagccccatggtggagcaggctgtgcagactggttctgctgacaacctgaatgctaaaaagctgttacctggcaagggcaccacagggacgcagctcaacggtcgtcaggcccagccgagcagcaagacggccagcgatgtagtccagccggcagctgtgcaagctcaagggcaggtgaatgacgagaacagaagacctcagaggaggcgatcaggaaacaggcgaacaaggaatcgctccagagggcaaaaccgtccaactaacgttaaggaaaacacaatcaaatttgagggtgactttgatttcgagagtgcaaatgcccagttcaaccgagaggagcttgacaaagaatttaagaagaaactgaattttaaagatgacaaggctgagaagggggaagagaaggacctggctgtggtgacccagagtgccgaagcgcccgctgaggaagaccttctggggcccaactgctactatgacaaatccaagtcgttcttcgacaacatctcttctgaactcaagaccagctccaggcggacgacgtgggccgaagagaggaagctcaacacagagacctttggggtgtcagggaggtttcttcgtggccgcagttctcggggcggattccgaggaggcaggggcaatgggaccacccgtcgcaaccccacttcccacagggccgggactggcagggtgtgagggtgcagccaaaggctcctactgaagtggcgcataactgacgctgtgtgtgtcaggacncgaggaaaacgctgcacttacagggaaagggggtcnctttgtttacggagtttggaaaaacccntactgctacttgtgttttggnacttaactgaacttggaaatgggcctgantnaaaaccnctttttttngggnaaatattcntggggtaaccccctttggaggcctttttancnggggttnccttttnantngcccanancccaattntnaaggttttggnantttncnaaaaggntttctaaaangnaaanctnaacccttacttngggacttttttttttttttatgacaacctttacttttnaaaangaaccnaatctnttgggaaagggggnnccnanaattttn

SEQ ID NO: 240 - DNA, 1401 bp, Human
  misc_feature (1)..(1): n is a, c, g, or t
  misc_feature (9)..(9): n is a, c, g, or t
  misc_feature (26)..(26): n is a, c, g, or t
  misc_feature (28)..(28): n is a, c, g, or t
ngcggaacntaacagggtcgactatnanagatgcatcaccatcaccatcacggtcgacccacgcgtccgctccacgaggacgactggcgatctcggccttcccggggccctgccctcaccccgatccgggatgaggagtggggtggccactccccccggagtcccaggggatgggaccaggagcccgccagggagcaggcaggcgggggctggcgggccaggcggccccgggcccgctccgtggacgccctggacgacctcaccccgccgagcaccgccgagtcagggagcaggtctcccacgagtaatggtgggagaagccgggcctacatgaccccgcggagccgcagccgggacgacctctatgaccaagacgactcgagggacttcccacgctcccgggacccccactacgacgacttcaggtctcgggagcgccctcctgcagaccccaggtcccaccaccaccgtacccgggaccctcgggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaagaacttggccctgagtccgggaagtttagtcgtctgatctgacacatcctacgaccctttcgcacctccaacctcccactcaactcaccactcccacaccccctccacaaccccatccccctcatcttccaacccttttctctcaacaccccaaccctccctccctatccactcaacataccctccaccccatttcccaccccccccaccctccaaaccactcctccaacactcttctctccccccctccaccccatacctcccccctcacactctcaacctccctattcacccccaaatcctttcacccaccccactctctcctcctacctcccatccatacccccacccccacactttcaccctatccacactccactctctccctcctaccccttctctttcaactcctccacaacccatcataccctcctccctcccctcatcacctacctcccctttccctcctctccccactaccatctcttcacctccactctaacctctctcctacccctctatccccgtcaaacaacaccctcagacacacaacaacccctctactcactccccacccatcccccctacatctttccatcaataccactataccattatcatctaccacccacttacaccctccttcactgacatctcactcaacctcataatcccctctcatacatccctactcccaccctctcctctccttcatcccactcccaac

SEQ ID NO: 241 - DNA, 1161 bp, Human
  misc_feature (849)..(849): n is a, c, g, or t
  misc_feature (894)..(894): n is a, c, g, or t
  misc_feature (937)..(937): n is a, c, g, or t
  misc_feature (950)..(950): n is a, c, g, or t
  misc_feature (957)..(957): n is a, c, g, or t
  misc_feature (959)..(959): n is a, c, g, or t
  misc_feature (976)..(977): n is a, c, g, or t
  misc_feature (984)..(984): n is a, c, g, or t
  misc_feature (1002)..(1002): n is a, c, g, or t
  misc_feature (1004)..(1004): n is a, c, g, or t
  misc_feature (1015)..(1015): n is a, c, g, or t
  misc_feature (1022)..(1022): n is a, c, g, or t
  misc_feature (1040)..(1040): n is a, c, g, or t
  misc_feature (1042)..(1042): n is a, c, g, or t
  misc_feature (1047)..(1047): n is a, c, g, or t
  misc_feature (1054)..(1054): n is a, c, g, or t
  misc_feature (1058)..(1058): n is a, c, g, or t
  misc_feature (1060)..(1060): n is a, c, g, or t
  misc_feature (1062)..(1062): n is a, c, g, or t
  misc_feature (1067)..(1067): n is a, c, g, or t
  misc_feature (1070)..(1070): n is a, c, g, or t
  misc_feature (1078)..(1080): n is a, c, g, or t
  misc_feature (1090)..(1090): n is a, c, g, or t
  misc_feature (1105)..(1105): n is a, c, g, or t
  misc_feature (1118)..(1118): n is a, c, g, or t
  misc_feature (1125)..(1125): n is a, c, g, or t
  misc_feature (1137)..(1137): n is a, c, g, or t
  misc_feature (1147)..(1147): n is a, c, g, or t
  misc_feature (1149)..(1149): n is a, c, g, or t
tagagaaattactatgagaggatcgcatcaccatcaccatcacggatcctatttaggtgacactatagaatcgtcgacccacgcgtccgattttttctttgaacttgatgccatggatcatctgcagtcattcattgcagattgtgatcgtagaacagaagtggccaagaaaagattagcagaaactcaagaagagattagtgctgaagtagcagcaaaggcagaacgtgttcatgagttaaatgaagaaattggtaaattgttagccaaggtggaacaactaggagctgaagggaatgtggaggaatcccagaaagtaatggatgaagtagagaaagcacgggcaaagaaaagagaagcagaggaagtttatcggaattctatgccagcttccagttttcagcagcagaaacttcgagtctgtgaagtctgctctgcctatttaggacttcatgataatgacagacgactggctgatcattttgggggtaaactgcacctgggatttattgaaataagagagaagcttgaagaattaaagagagtcgtagctgagaagcaggagaaaagaaaccaggaacggctgaaacgaagagaagagagagagagagaagaaagggagaagctgaggaggtcccgatcacacagcaagaatccaaaaagatccaggtccagagagcatcgcagacatcgatctcgctccatgtcacgtgaacgcaagaggagaactcgatccaaatctcgggagaaacgccatcgccacaggtcccgctccagcagccgtagccgcagccgtagccaccagagaagtcggcacagttctagagataggagcagagaacgatccangaggagatcctcaaagaaagattcagagaccaagacttagcatcntgtgacagagacaggagttcagagacagatcacctcgtgacanaatcggaagatanaagcggncntatgaaatgctatggcnnatcaaanacaggaggactctgaaancncgaacaggganatctacntagctgggtcatttctcngncctancttcctnggantncntactntgnttaattcnnnctgttccggngacgggaccaatccnacccgatccgctngctaatnacgttccactgnttgactgacngnttcctgagagcc

SEQ ID NO: 242 - DNA, 866 bp, Human
agatactatgagaggatcgctcccatcaccatcacggatcctatttaggtgacactatagaatcgtcgactctggaccttggctgtcactcagttgaccaagtgaagctgaaccatcctgtcactcacgttgaccagtcaagtgacaacatcatcatagagacgctgaaccatgaacattatgagtgcaaatacgtagttaatgcgatccctccgaccttgactgccaagattcacttcagaccagagcttccagcagagagaaaccagttaattcagcgtcttccaatgggagctgtcattaagtgcatgatgtattacaaggaggccttctggaagaagaaggattactgtggctgcatgatcattgaagatgaagatgctccaatttcaataaccttggatgacaccaagccagatgggtcactgcctgccatcatgggcttcattcttgcccggaaagctgatcgacttgctaagctacataaggaaataaggaagaagaaaatctgtgagctctatgccaaagtgctgggatcccaagaagctttacatccagtgcattatgaagagaagaactggtgtgaggagcagtactctgggggctgctacacggcctacttccctcctgggatcctgactcaatatggaagggtgattcgtcaacccgtgggcaggattttctttgcgggcacagagactgccacaaagtggagcggctacatggaagggggcatttgagctggagaacaaccgctaggaggtcttaaatgtctcgggaaggtgacgaaaaaactcggggaccagacccgatcaaggaagtccacggtaaaaacaccaccctctggaaaggaccgccactgttcc

SEQ ID NO: 243 - DNA, 944 bp, Human
catcaccatcaccatcacggatcctatttaggtgacactatagaatcgtcgacccacgcgtccgcctgtctggtcaacggcgaggagcgagagcagactcaccgggctgtgttcaggttcatcccgcggcatccagacgagctggagctggatgtggatgaccctgtgttggtggaggccgaggaggacgacttctggttccgtggcttcaacatgcgcacgggggagcgcggtgtgtttcctgccttctacgcccatgcggtgcccggccctgccaaggacctgctggggagtaagcggagcccctgctgggtggagcgctttgacgtgcagttcctgggctccgtggaggtgccctgccaccagggcaacggcatcctgtgtgcagccatgcagaagattgccactgcccggaaactgaccgtccacctgcgccctcctgcctcctgtgacctcgagatctctcttcggggggtcaagctgagtctgagcggaggagggcctgagttccagcgctgcagccatttcttccagatgaagaacatctccttctgcggctgccatccccgcaacagctgctatttcggcttcatcaccaaacaccccctgctgagccgcttcgcctgccacgtctttgtctcccaggagtccatgaggccggtggcgcagagtgtgggccgcgccttcctggagtactaccaagagcacctggcgtacgcctgccccacggaggacatctacctggagtagcctgcccaccgctctgtctcctggccgtctgctccaggcgcagctggggctgaggatgtctcaagaggccaccatggctttggcaaggactggattggggggacatgggaccttacgcttgtgggggtctgcgggctgggactctcgtcctcggtccccagggcgcagctgttggggctgcgggggagtggagc

SEQ ID NO: 244 - DNA, 1075 bp, Human
  misc_feature (852)..(852): n is a, c, g, or t
  misc_feature (855)..(855): n is a, c, g, or t
  misc_feature (885)..(885): n is a, c, g, or t
  misc_feature (899)..(899): n is a, c, g, or t
  misc_feature (941)..(941): n is a, c, g, or t
  misc_feature (943)..(943): n is a, c, g, or t
  misc_feature (950)..(950): n is a, c, g, or t
  misc_feature (958)..(958): n is a, c, g, or t
  misc_feature (964)..(964): n is a, c, g, or t
  misc_feature (966)..(966): n is a, c, g, or t
  misc_feature (969)..(969): n is a, c, g, or t
  misc_feature (972)..(972): n is a, c, g, or t
  misc_feature (974)..(974): n is a, c, g, or t
  misc_feature (993)..(993): n is a, c, g, or t
  misc_feature (997)..(997): n is a, c, g, or t
  misc_feature (1002)..(1002): n is a, c, g, or t
  misc_feature (1007)..(1007): n is a, c, g, or t
  misc_feature (1010)..(1010): n is a, c, g, or t
  misc_feature (1013)..(1013): n is a, c, g, or t
  misc_feature (1015)..(1015): n is a, c, g, or t
  misc_feature (1026)..(1026): n is a, c, g, or t
  misc_feature (1033)..(1033): n is a, c, g, or t
  misc_feature (1047)..(1047): n is a, c, g, or t
  misc_feature (1058)..(1058): n is a, c, g, or t
  misc_feature (1061)..(1061): n is a, c, g, or t
  misc_feature (1070)..(1070): n is a, c, g, or t
  misc_feature (1073)..(1073): n is a, c, g, or t
agagagaattactatgagaggatcgcatcaccatcaccatcacggatcctatttaggtgacactatagaatcgtcgacccacgcgtccgagagccgccagcgcgtgcgctacgactcctccaaccaggtcaagggcaagcccgacctgaacacggcgctgcccgtgcgccagacggcgtccatcttcaagcagccggtgaccaagattaccaaccaccccagcaacaaggtcaagagcgacccgcagaaggcggtggaccagccgcgccagctcttctgggagaagaagctgagcggcctgaacgccttcgacattgctgaggagctggtcaagaccatggacctccccaagggcctgcagggggtgggacctggctgcacggatgagacgctgctgtcggccatcgccagcgccctgcacactagcaccatgcccatcacgggacagctctcggccgccgtggagaagaaccccggcgtatggctcaacaccacgcagcccctgtgcaaagccttcatggtgaccgacgaggacatcaggaagcaggaagagctggtgcagcaggtgcggaagcggctggaggaggcgctgatggccgacatgctggcgcacgtggaggagctggcccgtgacggggaggcgccgctggacaaggcctgcgctgaggacgacgacgaggaagacgaggaggaggaggaggaggagcccgacccggacccggagatggagcacgtctagggcagaggccctgccgagagcccgtgctgcctgctggagccgcctgcagacgcggtcctcggccccacgtgaaccaggctcggcggcgaagcccagccttggagacacccagnagnaaggccgtgctcctggcttccttcctcggnccgtcccacttccnggggcctcggggcacacagctggggctgcccccacccgaaanancctccangctcgtcntctaanantcnggntncggaaatgccgggtgctcntggncctgnctggntcntananctttgggctcnaggccantcctcccatgcccnttttccacttnttnaaatggaanaanca

SEQ ID NO: 245 - DNA, 1066 bp, Human
  misc_feature (10)..(10): n is a, c, g, or t
  misc_feature (800)..(800): n is a, c, g, or t
  misc_feature (813)..(813): n is a, c, g, or t
  misc_feature (823)..(823): n is a, c, g, or t
  misc_feature (856)..(856): n is a, c, g, or t
  misc_feature (886)..(886): n is a, c, g, or t
  misc_feature (920)..(920): n is a, c, g, or t
  misc_feature (923)..(923): n is a, c, g, or t
  misc_feature (925)..(925): n is a, c, g, or t
  misc_feature (928)..(928): n is a, c, g, or t
  misc_feature (931)..(931): n is a, c, g, or t
  misc_feature (936)..(936): n is a, c, g, or t
  misc_feature (940)..(940): n is a, c, g, or t
  misc_feature (945)..(945): n is a, c, g, or t
  misc_feature (957)..(957): n is a, c, g, or t
  misc_feature (967)..(967): n is a, c, g, or t
  misc_feature (971)..(971): n is a, c, g, or t
  misc_feature (984)..(984): n is a, c, g, or t
  misc_feature (1000)..(1000): n is a, c, g, or t
  misc_feature (1003)..(1003): n is a, c, g, or t
  misc_feature (1010)..(1010): n is a, c, g, or t
  misc_feature (1019)..(1019): n is a, c, g, or t
  misc_feature (1021)..(1022): n is a, c, g, or t
  misc_feature (1025)..(1025): n is a, c, g, or t
  misc_feature (1037)..(1037): n is a, c, g, or t
  misc_feature (1039)..(1039): n is a, c, g, or t
  misc_feature (1044)..(1045): n is a, c, g, or t
  misc_feature (1053)..(1053): n is a, c, g, or t
taatagaganattactatgagaggatcgcatcaccatcaccatcacggatcctatttaggtgacactatagaatcgtcgacccacgcgtccgacaacatgctgctggtcagtgaagagcccaaggtcaaggagatggtacggatcttaaggactgtgccattcctgccgctgctaggtggctgcattgatgacaccatcctcagcaggcagggctttatcaactactccaagctccccagcctgcccctggtgcagggggagcttgtaggaggcctcacctgcctcacagcccagacccactccctgctccagcaccagcccctccagctgaccaccctgttggaccagtacatcagagagcaacgcgagaaggattctgtcatgtcggccaatgggaagccagatcctgacactgttccggactcgtagccagcctgtttagccagccctgcgcataaatacactctgcgttattggctgtgctctcctcaatgggacatgtggaagaacttggggtcgaggagtgtgtttgtcacttggttttcactagtaatgatattgtcaggtatagggccacttggagatgcagaggattccatttcagatgtcagtcaccggcttcgtccttagttttcccaacttgggacgtgataggagcaaagtctctccattctccaggtccaaggcagagatcctgaaaagatagggctattgtcccctgcctccttggtcactgcctcttgctgcacgggctcctgagcccacccccttggggcacaacctgccactgccacagtanctcaaccaagcanttgtgctganaatggcacctggtgagagcctgctgtgtgccangctctgtgctgagtgctgtacatgtattanttcctttactgctgaccacattgtacccatttcncananaangancaaanaaanttaantggcttgctcanggtcatgcanttantaatggcaaaaanaggaacttgaaccaanccntctgctntgaaaaccncnnccngaatttttttcncnaaaannttcctcancaggttacccaaa

SEQ ID NO: 246 - DNA, 831 bp, Human
  misc_feature (1)..(3): n is a, c, g, or t
  misc_feature (796)..(796): n is a, c, g, or t
  misc_feature (800)..(800): n is a, c, g, or t
  misc_feature (807)..(808): n is a, c, g, or t
  misc_feature (812)..(812): n is a, c, g, or t
  misc_feature (814)..(831): n is a, c, g, or t
nnnaaaaaattaagagatactatgagaggtcgcatcaccatcaccatcacggatcctatttaggtgacactatagaatcgtcgactctggaccttggctgtcactcagttggaggacccttgacctctggcccaagatggtggcgcccagagcttcgctcttgctgctcccctgagagaggcgtttccatcaaccagttttgcaaggagttcaatgagaggacaaaggacatcaaggaaggcattcctctgcctaccaagattttagtgaagcctgacaggacatttgaaattaagattggacagcccactgtttcctacttcctgaaggcagcagctgggattgaaaagggggcccggcaaacagggaaagaggtggcaggcctggtgaccttgaagcatgtgtatgagattgcccgcatcaaagctcaggatgaggcatttgccctgcaggatgtacccctgtcgtctgttgtccgctccatcatcgggtctgcccgttctctgggcattcgcgtggtgaaggacctcagttcagaagagcttgcagctttccagaaggaacgagccatcttcctggctgctcagaaggaggcagatttggctgcccaagaagaagctgccaagaagtgacccttgccccaccaactcccagatttcaaaggaggtagttgcaaaagctgtgcccaagggggaggaaaggaggtcacaccatatgatgatggttttcatgactttgaatgatatatttttgtacatctagctgtatcgaggcatcaggcctgaaataacatccnttcntacaaannaaanannnnnnnnnnnnnnnnnn

SEQ ID NO: 247 - DNA, 1341 bp, Human
  misc_feature (1)..(1): n is a, c, g, or t
  misc_feature (8)..(8): n is a, c, g, or t
  misc_feature (10)..(11): n is a, c, g, or t
  misc_feature (788)..(788): n is a, c, g, or t
  misc_feature (821)..(821): n is a, c, g, or t
  misc_feature (860)..(860): n is a, c, g, or t
nccaaacncnnttacgaaatactatagaggatgcgtaccatcaccatcacggtcgacccacgcgtccgaacaagcggatcttggccttgtgcatggggaaccatgaactatacatgcgccgtcgcaagcctgataccattgaggtgcagcagatgaaggcacaggcccgggaggagaagcaccagaagcagatggagcgtgctatgctggaaaatgagaagaagaagcgtgaaatggcagagaaggagaaagagaagattgaacgggagaaggaggagctgatggagaggctgaagcagatcgaggaacagactaagaaggctcagcaagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggccttggaaatggcagagctgacagctcgaatctcccagctggagatggcccgacagaagaaggagagtgaggctgtggagtggcagcagaaggcccagatggtacaggaagacttggagaagacccgtgctgagctgaagactgccatgagtacacctcatgtggcagagcctgctgagaatgagcaggatgagcaggatgagaatggggcagaggctagtgctgaccctacggctgatgctatggccaaggaccgcagtgagggagaacgtaccactgaagcagagaagaatgancgtgtgcagaagcacctgaaagccctcacttcngagctggccatgccagaaatgagtccaagaaaactgccnatgacatgatccctgctgaaaacatgcgactgggcccaaaaaaaaacaaaaccctgcgccaaatggcaagggcaaccccagcacgcatttgccaatttggtccttggattgggcccccacccctaggacccccccccctttttcttggcccccccctcctaacccaacccccaaacctaagggggggggccccaactaaaaaccccccggatctgcccacttttaggggcccggggaaaaaattcccctttcccccccccttctctggggaaaaaaggtccccaagggccagggacaccccttcccctcctcccccggaacggggggaaaaaaaccccctccccccgaaaggatctcccttgttttggggccccccccctttttctcaagaaaaaaaggggtgaaaatacaaggcccccccccccccccccccttcttgggaaaaaaaaaagaagggggcgcctccaaaaacaaacaccaa

SEQ ID NO: 248 - DNA, 1183 bp, Human
  misc_feature (1)..(1): n is a, c, g, or t
  misc_feature (859)..(859): n is a, c, g, or t
  misc_feature (897)..(897): n is a, c, g, or t
  misc_feature (900)..(900): n is a, c, g, or t
  misc_feature (905)..(905): n is a, c, g, or t
  misc_feature (922)..(922): n is a, c, g, or t
  misc_feature (952)..(952): n is a, c, g, or t
  misc_feature (969)..(969): n is a, c, g, or t
  misc_feature (974)..(974): n is a, c, g, or t
  misc_feature (978)..(978): n is a, c, g, or t
  misc_feature (984)..(985): n is a, c, g, or t
  misc_feature (993)..(993): n is a, c, g, or t
  misc_feature (998)..(998): n is a, c, g, or t
  misc_feature (1003)..(1003): n is a, c, g, or t
  misc_feature (1007)..(1007): n is a, c, g, or t
  misc_feature (1018)..(1018): n is a, c, g, or t
  misc_feature (1021)..(1021): n is a, c, g, or t
  misc_feature (1028)..(1028): n is a, c, g, or t
  misc_feature (1035)..(1035): n is a, c, g, or t
  misc_feature (1042)..(1042): n is a, c, g, or t
  misc_feature (1044)..(1044): n is a, c, g, or t
  misc_feature (1050)..(1050): n is a, c, g, or t
  misc_feature (1056)..(1056): n is a, c, g, or t
  misc_feature (1064)..(1064): n is a, c, g, or t
  misc_feature (1068)..(1068): n is a, c, g, or t
  misc_feature (1073)..(1073): n is a, c, g, or t
  misc_feature (1076)..(1076): n is a, c, g, or t
  misc_feature (1079)..(1079): n is a, c, g, or t
  misc_feature (1083)..(1083): n is a, c, g, or t
  misc_feature (1086)..(1087): n is a, c, g, or t
  misc_feature (1099)..(1099): n is a, c, g, or t
  misc_feature (1109)..(1109): n is a, c, g, or t
  misc_feature (1137)..(1137): n is a, c, g, or t
  misc_feature (1143)..(1143): n is a, c, g, or t
  misc_feature (1147)..(1147): n is a, c, g, or t
  misc_feature (1158)..(1158): n is a, c, g, or t
  misc_feature (1164)..(1165): n is a, c, g, or t
  misc_feature (1171)..(1171): n is a, c, g, or t
  misc_feature (1178)..(1178): n is a, c, g, or t
  misc_feature (1181)..(1181): n is a, c, g, or t
nattagagaaattactatgagaggatcgcatcaccatcaccatcacggatcctatttaggtgacactatagaatcgtcgacccacgcgtccgcccacgcgtccggccgcttgctccggccggcaccctaggccggcccgccgccagctgtcgccgacatggaacccttggccagcaacatccaggtcctgctgcaggcggccgagttcctggagcgccgtgagagagaggccgagcatggttatgcgtccctgtgcccgcatcgcagtccaggccccatccacaggaggaagaagcgacccccccaggctcctggcgcgcaggacagcgggcggtcagtgcacaatgaactggagaagcgcaggagggcccagttgaagcggtgcctggagcggctgaagcagcagatgcccctgggggccgactgtgcccggtacaccacgctgagcctgctgcgccgtgccaggatgcacatccaggtgaggccccccactgcgcccggactggcttgccctggtgtatggagggctgtgctatggaggggctggtgggactggggaacgagacctgaggtcagagctcaagaactgtgtgacttaggacagctctctgagcttttactttccagatccattaaatgggaagaaaagcagacaataactcagagggttgttgaggcttaaatgagttcactctataaatgttcactgttgctgttacagctgttatcacttaaatcacagctgtgagaccttgggcaggttacttaacctgtctggactaaccttccctcctgttttaagggaagggatggctgtttgaatttttgtgatgggatgtatgtggggggtcctttggantgtaaaagggttggttccttgctctcccccttttcacnttnaaagnctcctgttatggggcantctatcctgggtgccaccttgggaaggcanctcccagggaaaagganggggnaaangaattnnaaaaaaanccccntttcnttgnttcttccccanggnttcttgnttgttgnttggggntnaaattnaattgnccccctgnttgnaaaanaantgnaatnttnnttaaaaaaaagncccaagtggnccctggccaatttaaaaaatggcctttnaaaaancaanggaattttttnttgccnnttaaanaaaaaanttnaa

SEQ ID NO: 249 - DNA, 951 bp, Human
cgcatcaccatcaccatcacggatcctatttaggtgacactatagaatcgtcgacccacgcgtccgcccacgcgtccgaagaaaacaaaaagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaactatacttgaacaaaagggtcagaggacctgtatttaagcaaatacttagcaaaaagtggggcagagcctcccaaggagaacaaatattcagaatattcatattggaaaaatcacaatttttaatggcagc

SEQ ID NO: 250 - DNA, 904 bp, Human
  misc_feature (797)..(797): n is a, c, g, or t
tatgagaggtcgcatcaccatcaccatcacggatcctatttaggtgacactatagaatcgtcgactctggaccttggctgtcactcagtttaccccaaccagttgacagtgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaaccaccctgaaagcacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaatcattaacctccctgttgttgacttcacgaaatgatgtccaaagagcagttcaatgaaggctcacttgccatanttcgggatatcgtaggaggggtaagataaagtggctgctcagaatgcagaaaagaaactggaaatatatagactagagcagatttaatctttgaagatgaaagaaaa

SEQ ID NO: 251 - DNA, 2368 bp, Human
atgcctcaggttccgggtggtagcgttaaaccgaaaatcatgtctccggaaaaaagccatcgtgttattagcccgagcagcggttatagcagccagagcaataccccgaccgcactgacaccggttccggtttttctgaaaagcgtttctccggcaaatggtaaaggtaaaccgaaaccgaaagttccggaacgtaaaagcagcctgattagcagcgttagcattagcagcagcagcaccagcctgagcagctctaccagcaccgaaggtagcggcaccatgaaaaaactggaccctgcagttggttctcctccagcaccacctccacctccggttccgagccctccgtttccgtgtccggcagatcgtagcccgtttctgccaccgccaccgcctgttaccgattgtagccagggttctccgctgccgcattctccggtttttccgcctcctccgcctgaagcactgattccgttttgtagccctccggattggtgtctgagtccaccgcgtccggcactgagcccgattctgccggattcaccggtttctctgccgctgcctccgcctctgctgccgtctagtgaacctccacctgcaccaccgctggacccgaaatttatgaaagatacccgtccaccttttaccaatagcggtcagccggaaagcagccgtggtagcctgcgtccgcctagcaccaaagaagaaaccagccgtccgcctatgccgctgattaccaccgaagcactgcagatggttcagctgcgtccggttcgtaaaaatagcggtgcagaagctgcacagctgagcgaacgtaccgcacaggaacagcgtacaccggttgcaccgcagtatcatctgaaaccgagcgcatttctgaaatctcgcaacagcaccaatgaaatggaaagcgaaagccagcctgcaagcgttaccagcagcctgccgacaccggcaaaaagcagcagccagggtgatcatggtagcgcagcagaacgtggtggtccggttagccgttctccgggtgcaccgtctgccggtgaagcagaagcacgtccgagcccgtctaccacaccgctgccggatagcagcccgtcacgtaaaccgcctccgattagcaaaaaaccgaaactgtttctggtcgttccaccaccgcagaaagattttgcagttgaaccggcagaaaatgttagcgaagcactgcgtgcagttccgagcccgaccaccggtgaagaaggtagcgttcatagccgtgaagcaaaagaaagcagcgcagcacaggcaggtagccatgcaacccatccgggtacaagcgttctggaaggtggtgcagcaggtagcatgagcccgagccgtgttgaagcaaatgttccgatggttcagccggatgtttcaccggcaccgaaacaggaagaaccggctgaaaatagcgcagataccggtggagatggtgaaagctgtctgagccagcaggatggtgcagccggtgttccggaaaccaatgcagccggtagcagcagcgaagcatgtgattttctgaaagaagatggcaacgacgaagttatgacccctagccgtccgcgtaccaccgaggacctgtttgcagcaattcatcgtagcaaacgtaaagttctgggtcgtcgtgattctgatgatgaccatagccgtaatcactctccgtcaccaccggttacaccgaccggtgcagcaccaagcctggcaagcccgaaacaggttggtagcattcagcgtagcattcgtaaaagctcaaccagcagcgataattttaaagccctgctgctgaaaaaaggtagccgtagcgataccagcgcacgtatgagcgcagccgaaatgctgaaaaataccgatccgcgttttcagcgtagccgttctgaaccgtcaccggatgcaccggaaagcccgagcagttgtagcccgagcaaaaatcgtcgtgcacaggaagaatgggcaaaaaacgaaggtctgatgcctcgtagcctgtcatttagcggtccgcgttatggtcgtagccgtacccctccgagcgcagcaagcagccgttattctatgcgtaatcgtattcagagcagcccgatgaccgttattagcgaaggtgaaggtgaagccgttgaaccggttgatagcattgcacgtggtgcactgggtgcagcagaaggttgtagcctggacggtctggcacgtgaagaaatggatgaaggtggtctgctgtgtggtgaaggtccggcagcaagcctgcagcctcaggcaccgggtccggttgatggcaccgcaagcgcagaaggtcgcgaaccgagtccgcagtgtggtggtagcctgtccgaagaaagctaagcggccgcttaattaa

SEQ ID NO: 252 - DNA, 1116 bp, Human
  misc_feature (866)..(866): n is a, c, g, or t
  misc_feature (912)..(912): n is a, c, g, or t
  misc_feature (929)..(929): n is a, c, g, or t
  misc_feature (934)..(934): n is a, c, g, or t
  misc_feature (937)..(937): n is a, c, g, or t
  misc_feature (944)..(944): n is a, c, g, or t
  misc_feature (947)..(947): n is a, c, g, or t
  misc_feature (958)..(958): n is a, c, g, or t
  misc_feature (960)..(960): n is a, c, g, or t
  misc_feature (964)..(964): n is a, c, g, or t
  misc_feature (977)..(977): n is a, c, g, or t
  misc_feature (980)..(980): n is a, c, g, or t
  misc_feature (985)..(985): n is a, c, g, or t
  misc_feature (996)..(996): n is a, c, g, or t
  misc_feature (1002)..(1002): n is a, c, g, or t
  misc_feature (1007)..(1007): n is a, c, g, or t
  misc_feature (1013)..(1013): n is a, c, g, or t
  misc_feature (1021)..(1021): n is a, c, g, or t
  misc_feature (1026)..(1026): n is a, c, g, or t
  misc_feature (1054)..(1054): n is a, c, g, or t
  misc_feature (1058)..(1058): n is a, c, g, or t
  misc_feature (1062)..(1062): n is a, c, g, or t
  misc_feature (1066)..(1066): n is a, c, g, or t
  misc_feature (1070)..(1070): n is a, c, g, or t
  misc_feature (1073)..(1074): n is a, c, g, or t
  misc_feature (1089)..(1089): n is a, c, g, or t
  misc_feature (1093)..(1093): n is a, c, g, or t
  misc_feature (1104)..(1104): n is a, c, g, or t
  misc_feature (1106)..(1107): n is a, c, g, or t
  misc_feature (1111)..(1111): n is a, c, g, or t
  misc_feature (1115)..(1115): n is a, c, g, or t
agagaaattactatgagaggatcgcatcaccatcaccatcacggatcctatttaggtgacactatagaatcgtcgacccacgcgtccgagggacacagcccattgcgagaagtgaggtgttcaggtactccctgcagaagctggcatacacggtgtcgcggaccgggcggcaggtgttgggggagcgcaggcagcgagcccccaactgaggccccagctcccagccctgggcggccgtatcatcaggtgctcctgtgcatctcggccagcacgggagccagtgccgcgcaggaatgtggggtcccctgtgttccctcgccagaggagcacttggcaaggtcagtgaggggccagtagacccccggagaagcagtaccgacaatgacgaagataccagatcccttcccaacccctttgcaccggtcccactaaggggcagggtcgagagaggaggggggatagggggagcagacccctgagatctgggcataggcaccgcattctgatctggacaaagtcgggacagcaccatcccagccccgaagccagggccatgccagcaggccccaccatggaaatcaaaacaccgcaccagccagcagaatggacattctgacatcgccagccgacgccctgaatcttggtgcagcaccaaccgcgtgcctgtgtggcgggactggagggcacagttgaggaaggagggtggttaagaaatacagtggggccctctcgctgtcccttgcccagggcacttgcattccagcctcgctgcatttgctctctcgattcccctttcctcctcactgcctcccaagcccaccctactccaaaataatgtgtcacttgatttggaactattcaagcantaaaagtaaatgaatcccacctttactaaaaacactttctctgaanccccccttgcccctcantgatnttngcttttnccntggtctcatgnanttgnggtcaaaaattgnggnaatcnctaattgtacngattgntttantgtgcnttaatttntgtcnccccacctaaaatgtaaacctcctggangaanaggnaccncctntannaaaaaaaaaaaaaanaacntcccctttttncnnaaantgtnc

SEQ ID NO: 253 - DNA, 1213 bp, Human
  misc_feature (3)..(3): n is a, c, g, or t
  misc_feature (925)..(925): n is a, c, g, or t
  misc_feature (935)..(935): n is a, c, g, or t
  misc_feature (939)..(939): n is a, c, g, or t
  misc_feature (941)..(941): n is a, c, g, or t
  misc_feature (948)..(948): n is a, c, g, or t
  misc_feature (986)..(986): n is a, c, g, or t
  misc_feature (989)..(989): n is a, c, g, or t
  misc_feature (991)..(991): n is a, c, g, or t
  misc_feature (1001)..(1001): n is a, c, g, or t
  misc_feature (1014)..(1014): n is a, c, g, or t
  misc_feature (1021)..(1021): n is a, c, g, or t
  misc_feature (1031)..(1031): n is a, c, g, or t
  misc_feature (1049)..(1049): n is a, c, g, or t
  misc_feature (1053)..(1053): n is a, c, g, or t
  misc_feature (1056)..(1056): n is a, c, g, or t
  misc_feature (1069)..(1069): n is a, c, g, or t
  misc_feature (1082)..(1082): n is a, c, g, or t
  misc_feature (1090)..(1090): n is a, c, g, or t
  misc_feature (1100)..(1100): n is a, c, g, or t
  misc_feature (1108)..(1108): n is a, c, g, or t
  misc_feature (1115)..(1115): n is a, c, g, or t
  misc_feature (1129)..(1129): n is a, c, g, or t
  misc_feature (1138)..(1138): n is a, c, g, or t
  misc_feature (1146)..(1146): n is a, c, g, or t
  misc_feature (1153)..(1153): n is a, c, g, or t
  misc_feature (1162)..(1162): n is a, c, g, or t
  misc_feature (1172)..(1172): n is a, c, g, or t
  misc_feature (1175)..(1175): n is a, c, g, or t
  misc_feature (1177)..(1177): n is a, c, g, or t
  misc_feature (1182)..(1182): n is a, c, g, or t
  misc_feature (1185)..(1185): n is a, c, g, or t
  misc_feature (1196)..(1196): n is a, c, g, or t
  misc_feature (1204)..(1204): n is a, c, g, or t
  misc_feature (1207)..(1207): n is a, c, g, or t
atngagaaattactatgagaggatcgcatcaccatcaccatcacggatcctatttaggtgacactatagaatcgtcgacccacgcgtccgagcgcagctgtgagggagtcgctgtgatccggggccccggaacccgagctggagctgaagcgcaggctgcggggcgcggagtcgggagtgcaggcctgagtgttccttccagcatgtcggagggggagtcccagacagtacttagcagtggctcagacccaaaggtagaatcctcatcttcagctcctggcctgacatcagtgtcacctcctgtgacctccacaacctcagctgcttccccagaggaagaagaagaaagtgaagatgagtctgagattttggaagagtcgccctgtgggcgctggcagaagaggcgagaagaggtgaatcaacggaatgtaccaggtattgacagtgcatacctggccatggatacagaggaaggtgtagaggttgtgtggaatgaggtacagttctctgaacgcaagaactacaagctgcaggaggaaaaggttcgtgctgtgtttgataatctgattcaattggagcatcttaacattgttaagtttcacaaatattgggctgacattaaagagaacaaggccagggtcatttttatcacagaatacatgtcatctgggagtctgaagcaatttctgaagaagaccaaaaagaaccacaagacgatgaatgaaaaggcatggaagcgttggtgcacacaaatcctctctgccctaagctacctgcactcctgtgacccccccatcatccatgggaacctgacctgtgacaccatcttcatccagcacaacggactcatcaagattggctctgtggctcctgacactatcaacaatcatgtgaagacttgtcgagaagagcaaaaaaatctacncttctttgcnccanantatgganaagtcactaatgtgacaacagcagtggacatctactcnttngncatgtgtgcnctggaaatggcantgcttgnaaattcaggncaatggaaagtcctcatntgtnccnaaggaagccctcngcagtgccctccngcttctanaaaacccttncagagggnttttttncaaagtgcctgcantttgacctnttccaaancaaaacnaaaaaattntgttcccccnacntnttganggncctccttaaantcttgggnccntggttg

SEQ ID NO: 254 - DNA, 853 bp, Human
  misc_feature (722)..(722): n is a, c, g, or t
  misc_feature (777)..(777): n is a, c, g, or t
  misc_feature (789)..(789): n is a, c, g, or t
  misc_feature (801)..(801): n is a, c, g, or t
catagagagattactatgagaggtcgcatcaccatcaccatcacggatcctatttaggtgacactatagaatcgtcgactctggaccttggctgtcactcagttttgggggatttgccagctccggtgactccacaacctcgatcaattagtggcccttcagtaggagtaatggaaatgagatcacctttacttgcaggtgggtcaccaccacaaccagttgtaccagctcataaagataaaagtggcgctccaccagttagaagtatatatgatgacatttctagcccaggacttggatcaacacctttaacttcaagaagacagccaaacatttcagtaatgcagagtcctcttgttggagttacatctactcctggaacagggcaaagtatgtttagtccagcaagtatcggtcagccacgaaagacgacattatctcctgcccagttggatcctttttatactcaaggagattctttgacttcagaagatcacctcgaagactcttgggtgactgtatttgggtttcctcaagcatctgcttcctacatattactacaatttgcacagtatgggaatatcttaaaacatgtgatgtctaatacaggaaattggatgcatattcgttatcaatctaaactgcaggctcggaaagccttaagcaaagatgggaggatttttggagaatccatcatgattggtgtaaaaccatgtattgancaaagtgttatggaaagcagtgacagatgtgctttatcatctccatctttagccnttacacccaccnatcaaactctangtacaccacacaacctggaagtactccctagattctacaatgagacctctgc

SEQ ID NO: 255 - DNA, 1117 bp, Human
  misc_feature (875)..(875): n is a, c, g, or t
  misc_feature (907)..(907): n is a, c, g, or t
  misc_feature (941)..(941): n is a, c, g, or t
  misc_feature (943)..(943): n is a, c, g, or t
  misc_feature (952)..(952): n is a, c, g, or t
  misc_feature (958)..(958): n is a, c, g, or t
  misc_feature (968)..(968): n is a, c, g, or t
  misc_feature (980)..(980): n is a, c, g, or t
  misc_feature (1019)..(1019): n is a, c, g, or t
  misc_feature (1042)..(1042): n is a, c, g, or t
  misc_feature (1060)..(1062): n is a, c, g, or t
  misc_feature (1073)..(1073): n is a, c, g, or t
  misc_feature (1082)..(1082): n is a, c, g, or t
  misc_feature (1088)..(1088): n is a, c, g, or t
  misc_feature (1091)..(1091): n is a, c, g, or t
  misc_feature (1096)..(1096): n is a, c, g, or t
  misc_feature (1098)..(1098): n is a, c, g, or t
  misc_feature (1100)..(1101): n is a, c, g, or t
  misc_feature (1109)..(1109): n is a, c, g, or t
  misc_feature (1112)..(1112): n is a, c, g, or t
  misc_feature (1115)..(1115): n is a, c, g, or t
gagaaattactatgagaggatcgcatcaccatcaccatcacggatcctatttaggtgacactatagaatcgtcgacccacgcgtccgcccacgcgtccggagacctagctgtacagtttagctgtatagaagcagtgaacatggcttcaaagatactaaaaagctatgagtccagtcttccccagacacagcaagtggatcttgacttatccaggccacttttcacttctgctgcactgctttcagcatgcaagattctaaagctgaaagtggataaaaacaaaatggtagccacatccggtgtaaaaaaagctatatttgatcgactgtgtaaacaactagagaagattggacagcaggtcgacagagaacctggagatgtagctactccaccacggaagagaaagaagatagtggttgaagccccagcaaaggaaatggagaaggtagaggagatgccacataaaccacagaaagatgaagatctgacacaggattatgaagaatggaaaagaaaaattttggaaaatgctgccagtgctcaaaaggctacagcagagtgatttcagcttccaaactggtatacattccaaactgatagtacattgccatctccaggaagacttgacggctttgggattttgtttaaacttttataataaggatcctaagactgttgcctttaaatagcaaagcagcctacctggaggctaagtctgggcagtgggctggcccctggtgtgagcattagaccagccacagtgcctgattggtatagccttgtgtgctttcctacaaaatggaattggaggccgggcgcagtggctcacgcctgtaatcccagcactttgggaggccgaggtgggtggatcacntgaggtcaggagctcgagaccagcctggccancatggtgaaccccatctctactaaaatacaaaantnacccggggngatggngcatgcctgngatcccgctccncggtagctgaacaggacctcccttgaccgtggaagcaangttgcatgacccaattgcccccnccctccccctggggacannngaactttcccnaataataanaaatcnccnctggngnanncggacttnaanaanaa

SEQ ID NO: 256 - DNA, 921 bp, Human
ttaactatgagaggatcgcatcaccatcaccatcacggatcctatttaggtgacactatagaatcgtcgacccacgcgtccgcggagtgtggagcgagcggcagcgggagcagcggggacagtctggacaagagcatcacgctgccccccgacgagatcttccgcaacctggagaacgccaagcgcttcgccatcgacataggcgggtcgttaaccaagctggcctactattcaacggtacagcacaaagtcgccaaggtgcggtctttcgaccactccggaaaggacacagaacgtgaacatgagccgccctatgagatttcagttcaagaagagatcactgctcgactgcacttcattaagtttgagaatacctacatcgaagcctgcctggacttcatcaaagaccatctcgtcaacacagagaccaaggtcatccaggcgaccgggggcggggcctacaagttcaaggacctcatcgaagagaagctgcggctgaaagtcgacaaggaggacgtgatgacgtgcctgattaaggggtgcaacttcgtgctcaagaacatcccccatgaggccttcgtgtaccagaaggattccgaccctgagttccggttccagaccaaccacccccacattttcccctatcttcttgtcaatatcggctctggagtctccatcgtgaaggtggagacggaggacaggttcgagtgggtcggcggcagctccattggaggcggcaccttctgggggcttggcgctctgctcaccaaaacgaagaagtttgacgagctcctgcacctggcctcgaggggccagcacagcaatgtggacatgctggtgcgggacgtctacggcggcgcccaccagactctcgggctgagcgggaacctcatcgccagcagcttcgggaagtcggccacc

SEQ ID NO: 257 - DNA, 864 bp, Human
  misc_feature (1)..(1): n is a, c, g, or t
  misc_feature (655)..(655): n is a, c, g, or t
  misc_feature (690)..(690): n is a, c, g, or t
  misc_feature (797)..(797): n is a, c, g, or t
ngggcaatagagagaatactatgagaggatgcatcaccatcaccatcacggatcctatttaggtgacactatagaatcgtcgactctggaccttggctgtcactcagttgaagggactaaggacagccatgaccccctgccatcctgggcagagctgttgaggcccaagtaccgggcaccccagggctgctcaggtgtggacgagtgtgcccggcaggagggcctgactttctttggcacagagctagccccagtgcggcaacaggagctggcctctctgctaagaacatacttggcacggctgccctgggctgggcagctgaccaaggagctacccctctcacctgctttctttggtgaggatggcatcttccgtcatgaccgcctccgcttccgggattttgtggatgccctgcaggacagcttggaggaggtggctgtgcaacagacaggtgatgatgatgaagtacatgactttgaggacttcatcttcagccacttctttggagacaaagcactgaagaagaggtcagggaagaaggacaagcactcacagagcccaagagctgcggggcccacggaggggcacagccatagccaccaccaccaccaccggggctgacaccctgccccacagggaatggccttggcctgncccagcccaagatcccagcgttatctaactcctgnagggtggactctgtcctggcttgtttggtgtcctcagatatctttcacacagtagagcaaaatcaccagccctgcactgatgtcactttatgtagaaaaggacttanctggacttgtgttgccgtctatgcaaatgcatgcaaatactcccaggcctgggatgtgggcttgtgt

SEQ ID NO: 258 - DNA, 1091 bp, Human
  misc_feature (808)..(808): n is a, c, g, or t
  misc_feature (860)..(860): n is a, c, g, or t
  misc_feature (902)..(902): n is a, c, g, or t
  misc_feature (931)..(931): n is a, c, g, or t
  misc_feature (946)..(946): n is a, c, g, or t
  misc_feature (949)..(949): n is a, c, g, or t
  misc_feature (954)..(954): n is a, c, g, or t
  misc_feature (961)..(961): n is a, c, g, or t
  misc_feature (964)..(964): n is a, c, g, or t
  misc_feature (966)..(966): n is a, c, g, or t
  misc_feature (975)..(975): n is a, c, g, or t
  misc_feature (979)..(979): n is a, c, g, or t
  misc_feature (981)..(981): n is a, c, g, or t
  misc_feature (983)..(983): n is a, c, g, or t
  misc_feature (989)..(989): n is a, c, g, or t
  misc_feature (1002)..(1003): n is a, c, g, or t
  misc_feature (1030)..(1030): n is a, c, g, or t
  misc_feature (1032)..(1032): n is a, c, g, or t
  misc_feature (1047)..(1047): n is a, c, g, or t
  misc_feature (1052)..(1052): n is a, c, g, or t
  misc_feature (1055)..(1055): n is a, c, g, or t
  misc_feature (1060)..(1060): n is a, c, g, or t
  misc_feature (1062)..(1062): n is a, c, g, or t
  misc_feature (1068)..(1068): n is a, c, g, or t
  misc_feature (1071)..(1071): n is a, c, g, or t
  misc_feature (1073)..(1073): n is a, c, g, or t
  misc_feature (1089)..(1089): n is a, c, g, or t
agaaattactatgagaggatcgcatcaccatcaccatcacggatcctatttaggtgacactatagaatcgtcgacccacgcgtccggggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagactacgggtgcccaggtacaggtggcaggggacctgctccccaactccacagagcgagctgttacggtatctggggtgcctgatgccatcatcctgtgtgtgcgccagatctgcgctgttatcctggagtccccacccaaaggagccactatcccctaccatccgagcctctccctagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgtctagagacggccaagtctacctctggggggacgcccagctcggcccccgcanacctgcctgcccccttctcgccacccctgacggccctgcccacagctccccntggcctgctgggcacaccctatgccatctccctctccaattnatcggcctcagccatgccttcttggcttnacacctgcttcccanggncgccnccggctnggngnctaactgcnaaangnancactanggaacaaaaaggnnaacggcaaaattccccctatgagccantnagtaagaggggcagnagacncanagggntncttgcnccnanccccaagaaatccccngg

SEQ ID NO: 259 - DNA, 677 bp, Human
  misc_feature (1)..(3): n is a, c, g, or t
  misc_feature (672)..(672): n is a, c, g, or t
  misc_feature (674)..(674): n is a, c, g, or t
  misc_feature (676)..(677): n is a, c, g, or t
nnngaatagagagaatactatgagaggatgcatcaccatcaccatcacggatcctatttaggtgacactatagaatcgtcgactctggaccttggctgtcactcagttggcacagcgcggggccaggctgggtccagcagcgcgatggcagctcagcggctgggcaagcgcgtgctgagcaagctgcagtctccatcgcgggcccgcgggccagggggcagtcccggggggctgcagaagcggcacgcgcgcgtcaccgtcaagtatgaccggcgggagctgcagcggcggctggacgtggagaagtggatcgacgggcgcctggaggagctgtaccgcggcatggaggcagacatgcccgatgagatcaacattgatgaattgttggagttagagagtgaagaggagagaagccggaaaatccagggactcctgaagtcatgtgggaaacctgtcgaggacttcatccaggagctgctggcaaagcttcaaggcctccacaggcagcccggcctccgccagccaagcccctcccacgacggcagcctcagccccctccaggaccgggcccggactgctcacccctgaccctcttgcactctccctgccccccggacgccgcccagcttgcttgtgtataagttgtatttaatggttctgtaacaataaaananann

SEQ ID NO: 260 - DNA, 738 bp, Human
  misc_feature (1)..(1): n is a, c, g, or t
  misc_feature (3)..(3): n is a, c, g, or t
  misc_feature (499)..(500): n is a, c, g, or t
  misc_feature (510)..(510): n is a, c, g, or t
  misc_feature (557)..(557): n is a, c, g, or t
  misc_feature (560)..(560): n is a, c, g, or t
  misc_feature (591)..(591): n is a, c, g, or t
  misc_feature (594)..(594): n is a, c, g, or t
  misc_feature (644)..(644): n is a, c, g, or t
  misc_feature (649)..(649): n is a, c, g, or t
  misc_feature (657)..(657): n is a, c, g, or t
  misc_feature (668)..(668): n is a, c, g, or t
  misc_feature (671)..(671): n is a, c, g, or t
  misc_feature (685)..(685): n is a, c, g, or t
  misc_feature (695)..(695): n is a, c, g, or t
  misc_feature (698)..(698): n is a, c, g, or t
  misc_feature (711)..(711): n is a, c, g, or t
  misc_feature (714)..(714): n is a, c, g, or t
  misc_feature (716)..(717): n is a, c, g, or t
  misc_feature (720)..(721): n is a, c, g, or t
  misc_feature (723)..(723): n is a, c, g, or t
  misc_feature (726)..(726): n is a, c, g, or t
  misc_feature (732)..(732): n is a, c, g, or t
  misc_feature (734)..(734): n is a, c, g, or t
nanttagagaaattactatgagaggatcgcatcaccatcaccatcacggatcctatttaggtgacactatagaatcgtcgacccacgcgtccgccaaggaccacgggggcggcggcggcggtggcaaagaccagcagcagcagcagcaggaggcacctttaggcccgggtcccaagttttgcaaagccggccccctccaccactacccatccccctccccggaaagcagcaacccatccgctgccgccggcggcagcagcgcgaagccatccacagacttccacaacctggccagggagctggaaaactcccggggaggcagcagctgctccccagcccagagcctcagcagcggtagcggcagcggcggcggcggcggccaccaggaggcggagctgagtcccgacggcatcgccacgggcggcggcaaaggaaagaggaaattcccggaggaggcggcggagggcggcggtggcgctggtctggtagggggccgggnncgcttcgtanagcggcccctcccggcctccaaggaggatctggtgtgcacaccgcancantaccgagcctcgggcagctacttcggcctgnaanagaacggccgcctcttcgcgccgccaagtcccgagacgggcgaggcgaancgcancgccttcntggaggtgaanaangctgcccgcgcggncagcctgcangangaggggacagccnacngnncgnnantcncctccnangacc

SEQ ID NO: 261 - DNA, 1057 bp, Human
  misc_feature (17)..(17): n is a, c, g, or t
  misc_feature (36)..(36): n is a, c, g, or t
  misc_feature (72)..(72): n is a, c, g, or t
  misc_feature (761)..(761): n is a, c, g, or t
  misc_feature (865)..(865): n is a, c, g, or t
  misc_feature (925)..(925): n is a, c, g, or t
  misc_feature (952)..(952): n is a, c, g, or t
  misc_feature (954)..(954): n is a, c, g, or t
  misc_feature (970)..(970): n is a, c, g, or t
  misc_feature (977)..(977): n is a, c, g, or t
  misc_feature (991)..(991): n is a, c, g, or t
  misc_feature (1002)..(1002): n is a, c, g, or t
  misc_feature (1020)..(1020): n is a, c, g, or t
  misc_feature (1023)..(1024): n is a, c, g, or t
  misc_feature (1028)..(1028): n is a, c, g, or t
  misc_feature (1038)..(1057): n is a, c, g, or t
attagagagaattactntgagaggatcgcatccccntcatccatcacggatcctatttaggtgacactatanaatcgtcgacccacgcgtccggtaagatcccctgcaactggaagaagcaatttggcgcggagtgcaaataccagttccaggcctggggagaatgtgacctgaacacagccctgaagaccagaactggaagtctgaagcgagccctgcacaatgccgaatgccagaagactgtcaccatctccaagccctgtggcaaactgaccaagcccaaacctcaagcagaatctaagaagaagaaaaaggaaggcaagaaacaggagaagatgctggattaaaagatgtcacctgtggaacataaaaaggacatcagcaaacaggatcagttaactattgcatttatatgtaccgtaggctttgtattcaaaaattatctatagctaagtacacaataagcaaaaacaaaaagaaaagaaaatttttgtagtagcgttttttaaatgtatactatagtaccagtaggggcttataataaaggactgtaatcttatttaggaagttgacttatagtacatgataaatgatagacaattgaggtaagttttttgaaattatgtgacattttacattaaattttttttacattttttgggcagcaatttaaatgttatgactatgtaaactacttctcttgttaggtaatttttttcacctagatttttttcccaattgagaaaaatatatactaaacnaaaatagcaataaaacataatcactctatttgaagaaaatatcttgttttctgccaatagattttttaaaatgtagtcagcaaaatgggggtggggaagcagancatgtcctagttcaatgttgactttttttttttttttaaagaaaaagcttttaagacctnaaaatttcttttcccttttggcaaaancnttttgttttcttggtnaaaattntttttccctcctgnaggaaaaaaantacttagggaaaataaantcnngggngatgcgggannnnnnnnnnnnnnnnnnnn

SEQ ID NO: 262 - DNA, 1103 bp, Human
  misc_feature (104)..(104): n is a, c, g, or t
  misc_feature (124)..(124): n is a, c, g, or t
  misc_feature (130)..(130): n is a, c, g, or t
  misc_feature (156)..(156): n is a, c, g, or t
  misc_feature (168)..(168): n is a, c, g, or t
  misc_feature (177)..(177): n is a, c, g, or t
  misc_feature (183)..(184): n is a, c, g, or t
  misc_feature (270)..(270): n is a, c, g, or t
  misc_feature (281)..(281): n is a, c, g, or t
  misc_feature (304)..(304): n is a, c, g, or t
  misc_feature (314)..(314): n is a, c, g, or t
  misc_feature (326)..(326): n is a, c, g, or t
  misc_feature (357)..(357): n is a, c, g, or t
  misc_feature (359)..(359): n is a, c, g, or t
  misc_feature (377)..(377): n is a, c, g, or t
  misc_feature (391)..(391): n is a, c, g, or t
  misc_feature (395)..(395): n is a, c, g, or t
  misc_feature (410)..(410): n is a, c, g, or t
  misc_feature (412)..(412): n is a, c, g, or t
  misc_feature (415)..(415): n is a, c, g, or t
  misc_feature (524)..(524): n is a, c, g, or t
  misc_feature (527)..(527): n is a, c, g, or t
  misc_feature (664)..(664): n is a, c, g, or t
  misc_feature (687)..(687): n is a, c, g, or t
  misc_feature (702)..(702): n is a, c, g, or t
  misc_feature (707)..(707): n is a, c, g, or t
  misc_feature (721)..(722): n is a, c, g, or t
  misc_feature (761)..(762): n is a, c, g, or t
  misc_feature (778)..(778): n is a, c, g, or t
  misc_feature (782)..(782): n is a, c, g, or t
  misc_feature (792)..(792): n is a, c, g, or t
  misc_feature (817)..(817): n is a, c, g, or t
  misc_feature (819)..(819): n is a, c, g, or t
  misc_feature (858)..(858): n is a, c, g, or t
  misc_feature (869)..(869): n is a, c, g, or t
  misc_feature (872)..(872): n is a, c, g, or t
  misc_feature (874)..(874): n is a, c, g, or t
  misc_feature (878)..(878): n is a, c, g, or t
  misc_feature (891)..(892): n is a, c, g, or t
  misc_feature (894)..(894): n is a, c, g, or t
  misc_feature (897)..(897): n is a, c, g, or t
  misc_feature (902)..(902): n is a, c, g, or t
  misc_feature (911)..(911): n is a, c, g, or t
  misc_feature (919)..(919): n is a, c, g, or t
  misc_feature (941)..(941): n is a, c, g, or t
  misc_feature (946)..(946): n is a, c, g, or t
  misc_feature (950)..(950): n is a, c, g, or t
  misc_feature (966)..(966): n is a, c, g, or t
  misc_feature (968)..(968): n is a, c, g, or t
  misc_feature (974)..(974): n is a, c, g, or t
  misc_feature (989)..(989): n is a, c, g, or t
  misc_feature (993)..(994): n is a, c, g, or t
  misc_feature (1011)..(1011): n is a, c, g, or t
  misc_feature (1019)..(1019): n is a, c, g, or t
  misc_feature (1026)..(1026): n is a, c, g, or t
  misc_feature (1035)..(1035): n is a, c, g, or t
  misc_feature (1041)..(1041): n is a, c, g, or t
  misc_feature (1059)..(1059): n is a, c, g, or t
  misc_feature (1074)..(1074): n is a, c, g, or t
  misc_feature (1077)..(1077): n is a, c, g, or t
  misc_feature (1084)..(1084): n is a, c, g, or t
  misc_feature (1090)..(1090): n is a, c, g, or t
  misc_feature (1094)..(1096): n is a, c, g, or t
  misc_feature (1098)..(1098): n is a, c, g, or t
tagagaaattactatgagaggatcgcatcaccatcaccatcacggatcctatttaggtgacactatagaatcgtcgacccacgcgtccggtttcattgtgggancattacaactgtgggctccnagtcanatgcagcagatccgcatgtcccttcncgggaaggctgnggtgctgangggcannaacaccatgatgcgcaaggccatccgagggcacctggaaaacaacccagctctggagaaactgctgcctcatatccgggggaatgngggctttgtgntcaccaaggaggacctcactganatcagggacntgttgctggccnataaggtgccagctgctgcccgtgctggtgncnttgccccatgtgaagtcnctgtgccagcccanaacnctggtctcgggcccnanaanacctcctttttccaggctttaggtatcaccactaaaatctccaggggcaccattgaaatcctgagtgatgtgcagctgatcaagactggagacaaagtgggagccagcnaanccacgctgctgaacatgctcaacatctcccccttctcctttgggctggtcatccagcaggtgttcgacaatggcagcatctacaaccctgaagtgcttgatatcacagaggaaactctgcattctcgcttcctgganggtgtccgcaatgttgccagtgnctgtctgcagattgnctacncaactgttgcatcnntaccccattctatcatcaacgggtacaaacgagtcctgnncttgtctgtggaaacngatnacaccttccnacttgctgaaaaagtcaaggccttncntggctgatccatctgcctttgtggctagctgcccctgtnactgctgccanaananctgnttcctgctgctgnngnaancccanctaaaggtngaaacccnaagaaaaaatccgaaggaatcngaacnaagnatatgggaatttgggncncctttnactaaatccccccanaaannaaccctactttaacccngtttttantttgccnaaacaaagnaaaatnaagggcttaacttctttnaaaaaaaaaaaaaanaangggcggnccgccncccnnnanggggg

SEQ ID NO: 263 - DNA, 869 bp, Human
gagaggtcgcatcaccatcaccatcacggatcctatttaggtgacactatagaatcgtcgacccacgcgtccggcggcggcaagatggcagtgcaaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagttcagaagaggtttggctttccagagggcagtgtagagctttatgctgaaaaggtggccactagaggtctgtgtgccattgcccaggcagagtctctgcgttacaaactcctaggagggcttgctgtgcggagggcctgctatggtgtgctgcggttcatcatggagagtggggccaaaggctgcgaggttgtggtgtctgggaaactccgaggacagagggctaaatccatgaagtttgtggatggcctgatgatccacagcggagaccctgttaactactacgttgacactgctgtgcgccacgtgttgctcagacagggtgtgctgggcatcaaggtgaagatcatgctgccctgggacccaactggtaagattggccctaagaagcccctgcctgaccacgtgagcattgtggaacccaaagatgagatactgcccaccacccccatctcagaacagaagggtgggaagccagagccgcctgccatgccccagccagtccccacagcataacagggtctccttggcagctgtattctggagtctggatgttgctctctaaagac

SEQ ID NO: 264 - DNA, 1085 bp, Human
  misc_feature (344)..(344): n is a, c, g, or t
  misc_feature (474)..(474): n is a, c, g, or t
  misc_feature (525)..(525): n is a, c, g, or t
  misc_feature (566)..(566): n is a, c, g, or t
  misc_feature (642)..(642): n is a, c, g, or t
  misc_feature (750)..(750): n is a, c, g, or t
  misc_feature (805)..(805): n is a, c, g, or t
  misc_feature (814)..(814): n is a, c, g, or t
  misc_feature (861)..(861): n is a, c, g, or t
  misc_feature (893)..(893): n is a, c, g, or t
  misc_feature (896)..(896): n is a, c, g, or t
  misc_feature (913)..(913): n is a, c, g, or t
  misc_feature (924)..(924): n is a, c, g, or t
  misc_feature (927)..(928): n is a, c, g, or t
  misc_feature (938)..(938): n is a, c, g, or t
  misc_feature (952)..(952): n is a, c, g, or t
  misc_feature (954)..(954): n is a, c, g, or t
  misc_feature (961)..(961): n is a, c, g, or t
  misc_feature (963)..(963): n is a, c, g, or t
  misc_feature (982)..(982): n is a, c, g, or t
  misc_feature (998)..(998): n is a, c, g, or t
  misc_feature (1007)..(1007): n is a, c, g, or t
  misc_feature (1016)..(1016): n is a, c, g, or t
  misc_feature (1019)..(1019): n is a, c, g, or t
  misc_feature (1027)..(1030): n is a, c, g, or t
  misc_feature (1032)..(1032): n is a, c, g, or t
  misc_feature (1042)..(1042): n is a, c, g, or t
  misc_feature (1051)..(1051): n is a, c, g, or t
  misc_feature (1060)..(1060): n is a, c, g, or t
  misc_feature (1074)..(1074): n is a, c, g, or t
  misc_feature (1076)..(1076): n is a, c, g, or t
  misc_feature (1078)..(1080): n is a, c, g, or t
tagagaaattactatgagaggatcgcatcaccatcaccatcacggatcctatttaggtgacactatagaatcgtcgacccacgcgttccgcccacgcgtccgcccacgcgttccgcgccggcggttgcctcgcggggttgcggcgagcccggcccgcgaacgtcacgtccctgcgcgctccctgcactctcccgagctgcgctaggcgggcgccacggctgcccggcgaaggaaaccgaaaccgagtccgggcccgtccctccgcggccccatccgcccggtgcacccggggtcgcgctcgccaggccgcggagcccagagctgcgcgcacgaaccgtgcgccnggagggcgtgggcgtggcgccgaagggtcccgggtcttcgacgcctctgcggcggctcctccctccttgcagttggatccctggcgggtgcggcccggcccggcccgtgagcggcgcacagaatgggccnatgctgcttctacacggcggggacgttgtccctgctcctgctggtgaccancgtcacgctgctggtggcccgggtcttccagaaggctgtanaccagagtatcgagaagaaaattgtgttaaggaatggtactgaggcatttgactcctgggagaagccccctctgcntgtgtatactcagttctatttcttcaatgtcaccaatccagaggagatcctcagaggggagacccctcgggtggaaaaaatggggccatacacctacagggaactcanaaacaaagcaaatattcaatttggagataatggaacaacaatatctgctgttaanaacaaaggnctatgtttttgaacgaaaaccaatctgtttggaaaaccctaaaattnaactttaattaaaaaatttaaataattcctgnaantgacttgtcaaaaaaantgggtcccaangtnnactttcctcnagggaaaatcatcnanggcccantntttaaaaagccttattaancaaaaaactttttttntgaaatcanaacaagttnaanaaaatttnnnntnttgggggctnaaaaaaaanaaaaaattnttgtcccctttaancnannnttttt

SEQ ID NO: 265 - DNA, 868 bp, Human
catcaccatcaccatcacggatcctatttaggtgacactatagaatcgtcgacccacgcgtccgcttttagcaccagtgtgggaaatgaggacgccaggacagcctggcccgaattacaacagagccatgctgttaatcagctcaaagatttgttgcgccaacaagcagataaggaaagtgaagtatctccgtcaagaagaagaaaaatgtcccccttgaggtcattagaacatgaggaaaccaatatgcctactatgcacgaccttgttcatactattaatgaccagtctcaatatattcatcatttagaggcagaagttaagttctgcaaggaggaactctctggaatgaaaaataaaatacaagtagttgtgcttgaaaacgaagggctccagcaacagctaaaatctcaaagacaagaggagacactgagggaacaaacacttctggatgcatccggaaacatgcacaattcttggattacaacaggtgaagattctggggtgggcgaaacctccaaaagaccattttcccatgacaatgcagattttggcaaagctgcatctgctggtgagcagctagaactggagaagctaaaacttacttatgaggaaaagtgtgaaattgaggaatcccaattgaagtttttgaggaacgacttagctgaatatcagagaacttgtgaagatcttaaagagcaactaaagcataaagaatttcttctggctgctaatacttgtaaccgtgttggtggtctttgtttgaaatgtgctcagcatgaagctgttctttcccaaacccatactaatgttcatatgcagaccatcgaaagactggttaaagaaagagatgacttgatgtctgcac

SEQ ID NO: 266 - DNA, 1051 bp, Human
  misc_feature (819)..(819): n is a, c, g, or t
  misc_feature (878)..(878): n is a, c, g, or t
  misc_feature (904)..(904): n is a, c, g, or t
  misc_feature (924)..(924): n is a, c, g, or t
  misc_feature (934)..(934): n is a, c, g, or t
  misc_feature (947)..(947): n is a, c, g, or t
  misc_feature (956)..(956): n is a, c, g, or t
  misc_feature (958)..(958): n is a, c, g, or t
  misc_feature (973)..(973): n is a, c, g, or t
  misc_feature (976)..(977): n is a, c, g, or t
  misc_feature (988)..(988): n is a, c, g, or t
  misc_feature (1000)..(1000): n is a, c, g, or t
  misc_feature (1015)..(1015): n is a, c, g, or t
  misc_feature (1029)..(1033): n is a, c, g, or t
  misc_feature (1035)..(1035): n is a, c, g, or t
  misc_feature (1038)..(1051): n is a, c, g, or t
tagagaaattactatgagaggatcgcatcaccatcaccatcacggatcctatttaggtgacactatagaatcgtcgacccacgcgtccgcagctgctgaatgccagaggccacgaagtgacgttggtctcccgaaagcccgggcccggccggatcacgtggcttactaccagcccagtctgactgcggagtatgatgaagacagcccaggaggggactttgactttttctccaacctcgtaaccaaatgggaagctgcagccaggcttcctggagattctacacgccaggtggtggtgcgctcaggggttgtgctgggccgtgggggtggtgccatgggccacatgctgctgccctttcgcctgggcctggggggccccatcggctcaggccaccaattcttcccctggatacacatcggggacctggcaggaatcctgacccatgcccttgaagcaaaccacgtgcacggggtcctgaatggagtggctccatcctccgccactaatgctgagtttgcccagaccttcggtgctgccctgggccgccgagccttcatccctctccccagcgctgtggtgcaagctgtctttgggcgacagcgtgccatcatgctgctggagggccagaaggtgatcccacggcgaacactggccactggctaccagtattccttcccagagctaggggctgccttaaaggaaattgtagcctaagtaggtcatggcaagggcctgaggcctgttcctcacaggcttccaggttaggcactgtgaataggctcagctcctctagagagctgaagccatctggttcttanattcctctcccagtcctctttcccattgttctgttgctccaccttattgtctcaaggcngtaatctcatcaggttgggacattantcttttcaactccttgtaanaattcccggnttggtttctctanatgtcctgnanctgccccacttctcnttnngctgtgtaaanaatgctctgcanttaaggcaataaaanaaattgtctccttnnnnnanaannnnnnnnnnnnnn

SEQ ID NO: 267 - DNA, 889 bp, Human
  misc_feature (730)..(730): n is a, c, g, or t
  misc_feature (740)..(740): n is a, c, g, or t
  misc_feature (789)..(789): n is a, c, g, or t
  misc_feature (807)..(807): n is a, c, g, or t
  misc_feature (868)..(868): n is a, c, g, or t
actatgagaggtcgcatcaccatcaccatcacggatcctatttaggtgacactatagaatcgtcgactctggaccttggctgtcactcagttagtgttgccaaggccctgggcgtgaagactgtgggggctcaggccctgaagctgtttcaggaacaccccattttctctgaagttatctcggaccaggaggctgtggccgccattgagaagttcgtggatgatgagaagatcctggtggagcccgcctgcggggcagccctggccgctgtctatagccacgtgatccagaagctccaactggaggggaatctccgaaccccgctgccatccctcgtggtcatcgtctgcgggggcagcaacatcagcctggcccagctgcgggcgctcaaggaacagctgggcatgacaaataggttgcccaagtgaggacggaccccttaccgatctgtgctctcctagcccaagagacccctggaggggctggagttttatccagcgcctcgtcgtatgtttggctgagcacctgtggcctgggtgcaggttaacttcttgttatcaggagcccactatgcagaggccaaaggtcggcagccagcgaggctatgaattggacctttttggtatctgtgtgactgctctgtgcccatccttagccaacttgctggcgtgacaagtgcccacaagtaacacaccaggtacccagagcagggtggacaggagagacctgnatcacagcantgaggaattcctcaaagctgtgacctcgccctgaactgttcccagtgangtcacagggcaccaccangggtgaggaacatctcaccatctccaaggagccaccctgaccttactattttctatgtgcnaactttcattgaaataaataa

SEQ ID NO: 268 - DNA, 988 bp, Human
  misc_feature (852)..(852): n is a, c, g, or t
  misc_feature (905)..(905): n is a, c, g, or t
  misc_feature (934)..(934): n is a, c, g, or t
  misc_feature (951)..(952): n is a, c, g, or t
  misc_feature (962)..(962): n is a, c, g, or t
  misc_feature (965)..(965): n is a, c, g, or t
  misc_feature (969)..(970): n is a, c, g, or t
  misc_feature (972)..(972): n is a, c, g, or t
  misc_feature (975)..(975): n is a, c, g, or t
  misc_feature (977)..(980): n is a, c, g, or t
  misc_feature (984)..(984): n is a, c, g, or t
caatagagagaattactatgagaggatcgcatcaccatcaccatcacggatcctatttaggtgacactatagaatcgtcgacccacgcgtccgcaggcatgccaccatctttttcaaagcccaatattgaaggtgccccaggggctcatattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggttttcctgaagtattctgataaatgtgttttttaaaacctcaatatactttttanaaaaggagcatctggttatgcataaagcagagctaaaactaaatttctttcangtcctcccctacttcccccaggggtcaancagaattaaaagtgggnnaatcccttanaanaaannanaanannnnaaanaaaa

SEQ ID NO: 269 - DNA, 801 bp, Human
  misc_feature (712)..(712): n is a, c, g, or t
  misc_feature (772)..(772): n is a, c, g, or t
  misc_feature (781)..(782): n is a, c, g, or t
tagagagatactatgagaggatgcatcaccatcaccatcacggatcctatttaggtgacactatagaatcgtcgataggtgagccagaggacgagacaactgtggtgaaggtgcccatgatgttgcagtcgagcaccatcagttaccttcatgactcagagctcccctgccagctggtgcagatgtactacgtgggcaatgggactgtcttcttcatccttccggacaaggggaagatgaacacagtcatcgctgcactgagccgggacacgattaacaggtggtccgcaggcctgaccagcagccaggtggacctgtacattccaaaggtcaccatctctggagtctatgaccttggagatgtgctggaggaaatgggcattgcagacttgttcaccaaccaggcaaatttctcacgcatcacccaggacgcccagctgaagtcatcaaaggtggtccataaagctgtgctgcaactcaatgaggagggtgtggacacagctggctccactggggtcaccctaaacctgacgtccaagcctatcatcttgcgtttcaaccagcccttcatcatcatgatcttcgaccacttcacctggagcagccttttcctggcgagggttatgaacccagtgtaagagaccacccacccagagcctcagcactgtctgactttgggaaccagggatcccacagaaatgttttggagagncggaggtttcccccatctcctccagtttctctccctccaccagagttgtgtctactttangcatctttnnataatgtcatgcgactctg

SEQ ID NO: 270 - DNA, 857 bp, Human
  misc_feature (797)..(798): n is a, c, g, or t
ccatagagagaatactatgagaggatgcatcaccatcaccatcacggatcctatttaggtgacactatagaatcgtcgactctggaccttggctgtcactcagttaggggtgacagtccaaagattgacttggccggcagttcgctatctggcatcctggacaaagatctctcggaccgcagcaatgacattgacttagaaggttttgactccgtggtatcatctactgagaaactcagtcatccgaccacaagcagaccaaaagctacagggaggcggcctccgtcccagtccctcacatcttcatccctttcaagccctgatatcttcgactccccaagtcccgaagaggataaggaggaacacatttcacttgcgcacagaggagtggacgcgtcaaagaaaacttccaagactgttaccatatcccaagtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaaacgagagattaaacagttattgtctgagttggatgaagagaagaaaatccggcttcggttgcagatggaagtgaacgacataaagaaagctctacnnatcaaatgaatactttgatcatgaaatgtcacattattcatcctgagtccgaagactca

SEQ ID NO: 271 - DNA, 834 bp, Human
gagagatactatgagaggtcgcatcaccatcaccatcacggatcctatttaggtgacactatagaatcgtcgactctggaccttggctgtcactcagttagctcagacccaggaagccctttccagatgccagctgatacgcccccacctgcttacctgcctcctgaagaccccatgacccaggatggctctcagccgatggacacaaacatgatggcgcctcccctgccctcagaaatcaacagaggagatgttcaggcggttgcttatgaggaaccaaaacactggtgctctattgtctactatgagctcaacaatcgtgtgggtgaagcgttccatgcctcctccacaagtgtgttggtggatggtttcactgatccttccaacaataagaaccgtttctgccttgggctgctctccaatgttaaccggaattccactattgaaaacaccaggcggcatattggaaaaggagttcatctttattatgttggaggggaggtgtatgccgaatgccttagtgacagtagcatctttgtgcaaagtcggaactgcaactaccatcatggatttcatcctactactgtttgcaagatccctagtgggtgtagtctgaaaatttttaacaaccaagaatttgctcagttattggcacagtctgtgaaccatggatttgagacagtctatgagctttacaaaatgtgtactatacgtatgagctttgtgaagggctggggagcagaataccaccgccaggatgttactagcaccccttgctgggattgagaacatctgcacgccccctccagtggctggataaagttcttactcaat

SEQ ID NO: 272 - DNA, 1037 bp, Human
  misc_feature (514)..(514): n is a, c, g, or t
  misc_feature (771)..(771): n is a, c, g, or t
  misc_feature (791)..(791): n is a, c, g, or t
  misc_feature (826)..(826): n is a, c, g, or t
  misc_feature (838)..(838): n is a, c, g, or t
  misc_feature (841)..(841): n is a, c, g, or t
  misc_feature (850)..(850): n is a, c, g, or t
  misc_feature (854)..(854): n is a, c, g, or t
  misc_feature (857)..(857): n is a, c, g, or t
  misc_feature (863)..(863): n is a, c, g, or t
  misc_feature (877)..(877): n is a, c, g, or t
  misc_feature (915)..(915): n is a, c, g, or t
  misc_feature (918)..(918): n is a, c, g, or t
  misc_feature (936)..(936): n is a, c, g, or t
  misc_feature (947)..(947): n is a, c, g, or t
  misc_feature (951)..(951): n is a, c, g, or t
  misc_feature (958)..(958): n is a, c, g, or t
  misc_feature (960)..(960): n is a, c, g, or t
  misc_feature (963)..(963): n is a, c, g, or t
  misc_feature (965)..(966): n is a, c, g, or t
  misc_feature (970)..(970): n is a, c, g, or t
  misc_feature (972)..(973): n is a, c, g, or t
  misc_feature (979)..(979): n is a, c, g, or t
  misc_feature (991)..(991): n is a, c, g, or t
  misc_feature (1009)..(1009): n is a, c, g, or t
  misc_feature (1016)..(1016): n is a, c, g, or t
  misc_feature (1030)..(1030): n is a, c, g, or t
  misc_feature (1035)..(1035): n is a, c, g, or t
  misc_feature (1037)..(1037): n is a, c, g, or t
aattagagaaattactatgagaggatcgcatcaccatcaccatcacggatcctatttaggtgacactatagaatcgtcgacccacgcgtccgcccacgcgtccgccgagccgagcgcgcggagcagctggggccggggcgcggatgctggaagttcacatcccgtcggtggggcccgaggccgaggggcccaggcagagcccggagaaaagccacatggtgttccgagtggaggtgctgtgcagcgggcgcagacacacggtgccaaggcgctacagcgagttccacgcgctgcacaagcgggtgaggcggcgccgacctcccaccggccccggcccagcctctgtccagcccccgcccaggccctgtgaggcgggcgggcgagccccagcctccgccacccccattactgcctcagtccctgcgcagccggtcagcccccgggcctctgtgggtgggttggggccttcctcgccctcggccggtccaccactcaccagggtctgtcccagtanagcccgaaggcgggggcgcgggagggcttctggctggggcgaagagggcttgagggctcagtcgggatgctgtgatcgcacgcggtaaacctccagtagatcaagaagctgtacaaagtgcccgacttcccctcgaaacgcctgcccaactggaggaccagagggttggaacagcgccggcagggcttggaggcttacatccagggcatcctgtacctgaaccaggaggtgcccaaggagttactggaattcctganacttcggcacttccccacanaccccaaggctagcaactggggcaccctgaggganttcctgcctggnganagcaagctnccancancaccancggcctgtcctgancttcatgtggatccctatgtttgaacccctcccaaaantcnctgccaaagtggtgggtnaaatggtgtgnttcnagggccntntananntttnannattcancccaaaaaaaancccaaccaaaaggggggncttgttncccttgttcctttngccancn

SEQ ID NO: 273 - DNA, 1923 bp, Human
atgagtatgcgtagcccgattagcgcacagctggcactggatggtgttggcaccatggttaattgtaccattaaaagcgaagaaaaaaaagagccgtgtcacgaagcaccgcagggtagcgcaaccgcagcagaaccgcagcctggtgatccggcacgtgcaagccaggatagcgcagatccgcaggcaccggcacagggtaattttcgtggtagctgggattgtagcagtccggaaggtaatggtagtccggaaccgaaacgtccgggtgttagcgaagcagcaagcggtagccaagaaaaactggattttaatcgcaacctgaaagaagtggttccggcaattgaaaaactgctgagcagcgattggaaagaacgttttctgggtcgtaatagcatggaagccaaagatgttaaaggcacccaagaaagcctggcagaaaaagaactgcagctgctggttatgattcatcagctgagcaccctgcgtgatcagctgctgaccgcacatagcgaacagaaaaatatggcagcaatgctgtttgaaaaacagcagcagcagatggaactggcacgtcagcagcaagagcagattgcaaaacagcaacaacagctgattcagcaacagcataaaatcaatctgctgcaacagcaaattcagcaggttaatatgccgtatgtgatgattccggcatttccgcctagccatcagccgctgccggttacaccggatagtcagctggccctgccgattcagccgattccgtgtaaaccggttgaatatccgctgcaactgctgcatagccctccggcaccggttgttaaacgtcctggtgcaatggcaacccatcatcctctgcaagaaccgagccagccgctgaatctgaccgcaaaaccgaaagcaccggaactgccgaataccagcagcagtccgagcctgaaaatgagcagctgtgttccgcgtcctccgagccatggtggtccgacccgtgatctgcagagcagccctccgagtctgccgctgggctttctgggcgaaggtgatgcagttaccaaagcaattcaggatgcacgccagctgctgcattcacatagcggtgccctggatggtagcccgaataccccgtttcgtaaagacctgattagcctggatagctcaccggcaaaagaacgtctggaagatggttgtgttcatccgctggaagaggcaatgctgagctgtgatatggatggttcacgtcattttccggaatcacgtaattccagccatatcaaacgtccgatgaatgcatttatggtttgggcaaaagatgagcgtcgtaaaattctgcaggcctttccggatatgcataatagcagcattagcaaaattctgggtagccgttggaaaagcatgaccaatcaagagaaacagccgtattacgaagaacaggcacgtctgagccgtcagcatctggaaaaatatccggattacaaatacaaaccgcgtccgaaacgtacctgtattgttgaaggtaaacgtctgcgtgtgggtgaatataaagcactgatgcgtacccgtcgtcaggatgcccgtcagagctatgttattccgcctcaggcaggtcaggttcagatgagcagcagtgatgttctgtatccgcgtgcagcaggtatgccgctggcacagccgctggttgaacattatgttcctcgtagtctggatccgaatatgccggttattgttaatacctgtagcctgcgtgaagagggtgaaggcaccgatgatcgtcatagcgttgcagatggtgaaatgtatcgttatagcgaagatgaagatagcgaaggcgaagagaaaagtgatggtgaactggttgttctgaccgatagatcttaagcggccgcctgggcctcatgggccttcctttcactgcccgctttccag

SEQ ID NO: 274 - DNA, 1368 bp, Human
  misc_feature (1)..(1): n is a, c, g, or t
  misc_feature (11)..(14): n is a, c, g, or t
  misc_feature (807)..(807): n is a, c, g, or t
  misc_feature (823)..(823): n is a, c, g, or t
  misc_feature (830)..(830): n is a, c, g, or t
  misc_feature (887)..(887): n is a, c, g, or t
  misc_feature (922)..(923): n is a, c, g, or t
nggggttcccnnnnctaagaatactagagaggatgcatcaccatcaccatcacggtcgacccacgcgtccgggcactgaaggtctcttggctgaaaaattggaggctttgatcactcagactcgagccaaacaggcagctaccatgagtgaagtggagtggagagggagaacggttccagtgaagattgacaaagtgcgcattttcttattaggactggctgataacgaagcagctattgtccaggctgaaagcgaagaaactaaggagcgcctgtttgaatcaatgctcagcgagtgtcgggacgccatccaggtggttcgggaggagctcaagccagatcagaaacagagagattatatccttgaaggagagccagggaaggtgtctaatcttcaatacttgcatagctacctgacttacatcaagctatcaacggcaatcaagcgtaatgagaacatggccaaaggtctgcagagggctctgctgcagcagcagccagaggatgacagcaagcgctcaccccggccccaggacctgatccgactctatgacatcatcttacagaatctggtggaattgctccagcttcctggtttagaggaagacaaagccttccagaaagagataggcctcaagactctggtgttcaaagcttacaggtgttttttcattgctcagtcctatgtgctggtgaagaagtggagcgaagcccttgtcctgtatgacagagtcctgaaatatgcaaatgaagtaaattctgatgctggcgccttcaagaacagcctaaaggacctgcctgatgtgncagagctcatcactcnagtgcgntcaaaagaagtgctccctgcaggccgcagccatccttgatgcaaacgacgctcatcnaacagagaactcctccctccaagtcaggacatagnnctctgggtgaaacgttttgaaatttcttgctggacccctcccttgtcccaagcaagccaaccttgtgacttccaccaggcttcagcccatccctgcaagcttttgtctttgactggcctcaacagggggcttcccacccttgaggacaattgggacgaaaacaagagggctcctgaaactccgggctctttggatcaggactccggcttcctcggggggggggaaattgtctccattcttttggaaaaccccccattctgaattatcccgtcttttgccccggagaatttaaccttccctcttctaaaaaaaaaaagggggcccccccgcaacccaattgatggcccctgtaaaaacaaaccccccctcgtttttaaccccgcccgcgtttttttaaaaaccctctgttttgctaaaaaaaaaaacaaatcccctttcccccaca

SEQ ID NO: 275 - DNA, 876 bp, Human
  misc_feature (3)..(3): n is a, c, g, or t
  misc_feature (6)..(10): n is a, c, g, or t
  misc_feature (14)..(14): n is a, c, g, or t
  misc_feature (845)..(845): n is a, c, g, or t
  misc_feature (854)..(854): n is a, c, g, or t
  misc_feature (858)..(858): n is a, c, g, or t
  misc_feature (860)..(860): n is a, c, g, or t
  misc_feature (864)..(865): n is a, c, g, or t
  misc_feature (870)..(870): n is a, c, g, or t
  misc_feature (874)..(875): n is a, c, g, or t
ttnccnnnnngcanttagagaaattactatgagaggatcgcatcaccatcaccatcacggatcctatttaggtgacactatagaatcgtcgacccacgcgtccgcagaaaacacgggcaagagagttgaggaaccgttaaaggataaagaaaagccagagagtgcgggaaaggcaaaaggagaaggaaagtcagagaggaagggaaagtcagagatgcagggaggatcaaagacagagggaaagccagagagagggggaagggcagagggtgaaggagagccagacagtgaaagagagccagagagtgagggagagccagaaagtgaaacaagggctgcaggaaagcgcccagctgaggatgatatacccaggaaagccaaaagaaaaaccaacaaggggctggctcagtacctcaagcaatataaggaagccatacatgatatgaatttcagcaatgaggacatgataagagaatttgacaacatggctagggtggaggataaaaggagaaaaagcaaacagaaattgggggcgtttttgtggatgcaaagaaatttacaggaccccttctatcctaggggtccaagggaattcaggggtggctgcagggccccacgaagggacactgaagacattccttatgtgtagtgtccctggcaggcatttgtcaggccatatgttttaaccttatggtaatactttgctttagtcgttcctcctgctaccagtagcgttttgacccacctgccagtgtttgcttgctctatgtttcagtagcagattttcacacatgtgcattgcaagagacgtcatgattcgtggaaaaataaagcagcttataatntccctacanaaananccanntcacntttnna

SEQ ID NO: 276 - DNA, 880 bp, Human
  misc_feature (823)..(823): n is a, c, g, or t
  misc_feature (847)..(847): n is a, c, g, or t
gagatactatgagaggtcgcatcaccatcaccatcacggatcctatttaggtgacactatagaatcgtcgactctggaccttggctgtcactcagttcgacttaaaaaaaatgactctaaaagcactggtaaaaacttggactcagttcagaaattacccaaggtgaacaaaaccaagtcagagaagccggctggagctgatttagccaagctgagaaaggtgcctgatgtgttgccagtgttgccagacctcccgttacccgcgatacaggccaattaccgtccactgccttccctcgagctgatatcctccttccagccaaagcgaaaagcgttctcttcaccccaggaagaagaagaagctgggtttactgggcgcagaatgaattccaagatgcaggtgtattctggttccaagtgtgcctatctccctaaaatgatgaccttacaccagcaatgcatccgagtacttaaaaacaacatcgattcaatctttgaagtgggaggagtcccatactctgttcttgaacccgttttggagaggtgtacacctgatcagctgtatcgcatagaggaatacaatcatgtattaattgaagaaacagatcaattatggaaagttcattgtcaccgagactttaaggaagaaagacccgaagagtatgagtcgtggcgagagatgtacctgcggcttcaggacgcccgagagcagcggctacgagtactaacaaagaatatccagttcgcacatgccaataagcccaaggcccgacagcaaagatggccttttgtcactctgtggccagcccactcgtgacgtccngagaagcaagaaaagttgaacggnaggagcactgtcctgagaaatcagaatcagcag

SEQ ID NO: 277 - DNA, 956 bp, Human
tatgagaggatcgcatcaccatcaccatcacggtcgacccacgcgtccggaggaattgaagaaactaaggcacccaactccgacaatgctgtcgatccaaaagtggcaattctctatgagtgcaattaaagaggaacaagaattaatggaagaaattaatgaagatgagcctgttaaagcaaaaaaacggaagagagacgataataaagacattgactcagagaaagaagctgccatggaagctgaaattaaagctgcccgagaaagggccattgtccctctggaggctcgaatgaagcagttcaaggacatgctgctagagagaggggtgtctgctttttcaacgtgggagaaggagttgcacaagatagtttttgatccccggtacttacttctcaatcctaaagagagaaaacaggtgtttgatcagtatgtaaagaccagggcagaggaagaacgcagggaaaagaaaaataaaataatgcaagccaaggaagatttcaaaaaaatgatggaagaagcaaaatttaatccaagagcaacttttagtgaatttgcagccaagcatgctaaagattcaagattcaaagcaattgaaaagatgaaagaccgagaagccttgtttaatgagtttgtggccgctgctaggaagaaagagaaagaagattcgaagaccagaggtgagaagattaaatcggatttctttgaactattatctaatcatcacttggacagtcagtctcgatggagcaaagtaaaagacaaagtagaaagtgatccacgttacaaagcagtagatagttcatcaatgagagaagaccttttcaaacagtacattgaaaaaatagccaagaatttagactcagaaaaagaaaaggagcttgaaaggcaagcccgcattgaggcaagccttcgagaacgagaaagggaggttcaaaaggcccgttcagaacaaa

SEQ ID NO: 278 - DNA, 1127 bp, Human
  misc_feature (873)..(873): n is a, c, g, or t
  misc_feature (902)..(902): n is a, c, g, or t
  misc_feature (911)..(911): n is a, c, g, or t
  misc_feature (914)..(914): n is a, c, g, or t
  misc_feature (918)..(918): n is a, c, g, or t
  misc_feature (926)..(926): n is a, c, g, or t
  misc_feature (937)..(937): n is a, c, g, or t
  misc_feature (949)..(949): n is a, c, g, or t
  misc_feature (954)..(954): n is a, c, g, or t
  misc_feature (979)..(979): n is a, c, g, or t
  misc_feature (981)..(981): n is a, c, g, or t
  misc_feature (997)..(997): n is a, c, g, or t
  misc_feature (1016)..(1016): n is a, c, g, or t
  misc_feature (1020)..(1020): n is a, c, g, or t
  misc_feature (1023)..(1023): n is a, c, g, or t
  misc_feature (1035)..(1035): n is a, c, g, or t
  misc_feature (1041)..(1041): n is a, c, g, or t
  misc_feature (1048)..(1048): n is a, c, g, or t
  misc_feature (1051)..(1051): n is a, c, g, or t
  misc_feature (1054)..(1054): n is a, c, g, or t
  misc_feature (1062)..(1062): n is a, c, g, or t
  misc_feature (1067)..(1067): n is a, c, g, or t
  misc_feature (1071)..(1071): n is a, c, g, or t
  misc_feature (1075)..(1075): n is a, c, g, or t
  misc_feature (1083)..(1083): n is a, c, g, or t
  misc_feature (1094)..(1094): n is a, c, g, or t
  misc_feature (1098)..(1099): n is a, c, g, or t
  misc_feature (1107)..(1107): n is a, c, g, or t
  misc_feature (1110)..(1110): n is a, c, g, or t
  misc_feature (1113)..(1113): n is a, c, g, or t
  misc_feature (1115)..(1116): n is a, c, g, or t
  misc_feature (1121)..(1121): n is a, c, g, or t
  misc_feature (1123)..(1125): n is a, c, g, or t
agagaattactatgagaggatcgcatcaccatcaccatcacggatcctatttaggtgacactatagaatcgtcgacccacgcgtccgtgcaggtagccggccggccgggggtcgcgggtatggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctgggatggtgtcagcgggccaggccgacagctccagcgaggacacctccagctccagtgatgagacagacgtggaggggaaaccctcagtaaaaccagcccaggtcaaagcctcatcagtttctactaaggagtctccagcaagaaaggcggccccagcccctgggaaggtgggggatgtgacaccccagntcaaaggaggggccctgcccccagccaanagggccaanaanccanaaaaggantcaaaaagtantgaggagggatntgaantgaggaggaggcccttgcagggacncnaaaccaggtaaaggcntctgaaaaattttcaggtnaaantgnctcacccctgcnaggganccctggnaanggntacccacnccccntggnaggnagggctgnaccttccaacnaggnnggaacccnagngantnnaaacncnnnag

SEQ ID NO: 279 - DNA, 643 bp, Human
agaattactatgagaggtcgcatcaccatcaccatcacggatcctatttaggtgacactatagaatcgtcgactctggaccttggctgtcactcagttggactttgcggagccatggagggcggcttcggctccgatttcgggggctccggcagcgggaagctggacccagggctcataatggagcaggtgaaagtgcagatcgccgtggccaacgcgcaggagctgctgcagaggatgacggacaagtgtttccggaagtgtatagggaaacctgggggctccctggacaactccgagcagaagtgcatcgccatgtgcatggaccgctacatggacgcctggaacaccgtgtctcgcgcctacaactcgcggctgcagcgggaacgagccaacatgtgaccggcgagcgcgggccaccccaccctgttcatttccataaacgtgctttgagaggcggggtccgcatgtacgtactgcctgcccggggcttaggagggtggcaccggtgctgggacacacgggactgtgtcctcgccaccccccgccctgccccctgccagccagtgcagcttggatctcgggggtgtggggccctgcgccttcctgaagtgctggcagcccagtggcacctccttcaggcc

SEQ ID NO: 280 - DNA, 1064 bp, Human
  misc_feature (1)..(1): n is a, c, g, or t
  misc_feature (762)..(762): n is a, c, g, or t
  misc_feature (790)..(790): n is a, c, g, or t
  misc_feature (809)..(809): n is a, c, g, or t
  misc_feature (837)..(837): n is a, c, g, or t
  misc_feature (865)..(865): n is a, c, g, or t
  misc_feature (870)..(870): n is a, c, g, or t
  misc_feature (875)..(875): n is a, c, g, or t
  misc_feature (887)..(887): n is a, c, g, or t
  misc_feature (938)..(940): n is a, c, g, or t
  misc_feature (943)..(943): n is a, c, g, or t
  misc_feature (953)..(953): n is a, c, g, or t
  misc_feature (962)..(962): n is a, c, g, or t
  misc_feature (973)..(973): n is a, c, g, or t
  misc_feature (990)..(990): n is a, c, g, or t
  misc_feature (992)..(992): n is a, c, g, or t
  misc_feature (999)..(1000): n is a, c, g, or t
  misc_feature (1006)..(1006): n is a, c, g, or t
  misc_feature (1011)..(1012): n is a, c, g, or t
  misc_feature (1017)..(1017): n is a, c, g, or t
  misc_feature (1029)..(1029): n is a, c, g, or t
  misc_feature (1038)..(1038): n is a, c, g, or t
  misc_feature (1045)..(1046): n is a, c, g, or t
  misc_feature (1056)..(1056): n is a, c, g, or t
  misc_feature (1059)..(1060): n is a, c, g, or t
ntagagaaattactatgagaggatcgcatcaccatcaccatcacggatcctatttaggtgacactatagaatcgtcgacccacgcgtccgaaaagaagctgaaagaccttgaagaggagaatgttgtacttcgatccgaggccagccagctgaagacagagaccatcacctatgaggagaaggagcagcagctggtcaatgactgcgtgaaggagctgagggatgccaatgtccagattgctagtatctcagaggaactggccaagaagacggaagatgctgcccgccagcaagaggagatcacacacctgctatcgcaaatagttgatttgcagaaaaaggcaaaagcttgcgcagtggaaaatgaagaacttgtccagcatctgggggctgctaaggatgcccagcggcagctcacagccgagctgcgtgagctggaggacaagtacgcagagtgcatggagatgctgcatgaggcgcaggaggagctgaagaacctccggaacaaaaccatgcccaataccacgtctcggcgctaccactcgctgggcctgtttcccatggattccttggcagcagagattgagggaacgatgcgcaaggagctgcagttggaagaggccgagtctccagacatcactcaccagaagcgtgtctttgagacagtaagaaacatcaaccaggttgtcaagcagagatctctgaccccttctcccatgaacatccccggctccaaccagtcctcggccatgaactccctcntgtccagctgcgtcagcaccccccggtncagcttctacggcagcganataggcaacgttcgtcctcgacaacaanaccaacagcattcatttttggaaaacanaggcngcccnacctgggaaacnattaaacggaattaaaaaacccgggaaccccggggcacccccaggctcccnnnacntgaaaacggnccttaaagnggctttccctncccccggaaaactaccncncgaaaannaggttnttttnnagagnaacaaaaaaagnaaccccccnaacttgnngaaaaagggnaannttgc

SEQ ID NO: 281 - DNA, 1198 bp, Human
  misc_feature (917)..(917): n is a, c, g, or t
  misc_feature (984)..(984): n is a, c, g, or t
  misc_feature (994)..(994): n is a, c, g, or t
  misc_feature (1026)..(1026): n is a, c, g, or t
  misc_feature (1029)..(1029): n is a, c, g, or t
  misc_feature (1047)..(1047): n is a, c, g, or t
  misc_feature (1056)..(1056): n is a, c, g, or t
  misc_feature (1070)..(1070): n is a, c, g, or t
  misc_feature (1085)..(1085): n is a, c, g, or t
  misc_feature (1090)..(1090): n is a, c, g, or t
  misc_feature (1100)..(1100): n is a, c, g, or t
  misc_feature (1102)..(1102): n is a, c, g, or t
  misc_feature (1107)..(1107): n is a, c, g, or t
  misc_feature (1117)..(1117): n is a, c, g, or t
  misc_feature (1132)..(1132): n is a, c, g, or t
  misc_feature (1141)..(1142): n is a, c, g, or t
  misc_feature (1147)..(1147): n is a, c, g, or t
  misc_feature (1154)..(1155): n is a, c, g, or t
  misc_feature (1164)..(1165): n is a, c, g, or t
  misc_feature (1168)..(1168): n is a, c, g, or t
  misc_feature (1170)..(1171): n is a, c, g, or t
  misc_feature (1174)..(1174): n is a, c, g, or t
  misc_feature (1177)..(1177): n is a, c, g, or t
  misc_feature (1180)..(1180): n is a, c, g, or t
  misc_feature (1185)..(1185): n is a, c, g, or t
tagagaaaattactatgagaggatcgcatcaccatcaccatcacggatcctatttaggtgacactatagaatcgtcgacccacgcgtccggccaggatggggacatcttgaggcaacgggatgaatttgatttgctggttgctggggagatctgccggtttagtgctcttattgaagaactggaggagaagaatgagaggccagcaagggagctcctgacggacatcagaagcactctaataagatgtgaaaccagaaagtgccggaaaccggtggctgtgtcgccagagctgggccagaggattcgggactttccccagcaggccctcccgctgcagagggagatgaagatgtttctggaaaaactatgctttgagttggactatgagccagctcacatttctctagaccctcagacttcccaccccaagctcctcttgtccgaggaccaccagcgagctcagttctcctacaaatggcagaactcaccagacaacccccagcgttttgaccgggccacctgtgttctggcccacactggcatcacaggggggagacacacgtgggtgtggatggccagggtacctggggactcaggctgctgccagttctgctcaccaccatccgtgcttggcacagaagtagctgcatagaaagggcactggatttgaagtcagaagacctgggttcttgaaccagcctgtcaaccagttgtatgactttaaacaaggcatctcacctcttttcatcttgttttcttccaataatgttagagttcatgtaatcacattctctagaaccatttagtttgtgttaactatgaaccaagcagtgtggtggccactggtgacttgaaaatatagagaaaaaaaaaacctgctctatatctgaaagagctcttgggaagaccgagaacnttaaagaggaaattaccgcccagtggtggtgggtgttacgggaaagtcccacccccagcattatggnagttcagggnaaggggcataacccaccctgaaaggaaagggngantgggggaatggctttttnaaaaagggnggtctaaggatgcntatggtcaatagggnaaaanagggaaaaancncttanaaaaagaaancccaaaaactgggtngaagacctnngaccntggaacnntgggttgtnnccntnnttntanggncaaangggggcatcccaa

SEQ ID NO: 282 - DNA, 1028 bp, Human
  misc_feature (1)..(3): n is a, c, g, or t
  misc_feature (794)..(794): n is a, c, g, or t
  misc_feature (811)..(811): n is a, c, g, or t
  misc_feature (860)..(860): n is a, c, g, or t
  misc_feature (922)..(922): n is a, c, g, or t
  misc_feature (969)..(969): n is a, c, g, or t
  misc_feature (973)..(973): n is a, c, g, or t
  misc_feature (980)..(983): n is a, c, g, or t
  misc_feature (985)..(985): n is a, c, g, or t
  misc_feature (991)..(993): n is a, c, g, or t
  misc_feature (996)..(996): n is a, c, g, or t
  misc_feature (1015)..(1015): n is a, c, g, or t
  misc_feature (1021)..(1021): n is a, c, g, or t
  misc_feature (1028)..(1028): n is a, c, g, or t
nnnaagcataactgacttaactataaataggcgtatccgaggccctttcgtcttcacctcgagaaatcataaaaaatttatttgctttgtgagcggataacaattataatagattcaattgtgagcggataacaatttcacacagaattcattaaagaggagaaattaactatgagaggatcgcatcaccatcaccatcacggtcgacccacgcgtccgggctctggcctcctccccagacccatcttttactgcagtttccccacgcggatgcctggagacaagcggtccccccggatcaccgggctctgtcccttcggtccccgggagatcctggtggcggatgagcagaaccgggcactgaaacgcttctccctcaacggcgactacaagggcaccgtgccggtccctgagggctgctccccttgcagcgtggccgccctgcagagcgcggtggccttctccgctagcgcacggctctatctcatcaaccccaacggcgaagtgcagtggcgcagggccctgagcctctcccaggccagccacgcggtggcggcactgcctagcggggaccgcgtggctgtcagcgtggcgggccacgtggaggtgtacaatatggaaggcagcctggccacccggttcattcctggaggcaaggccagccggggcctgcgggcgctggtgtttctgaccaccagcccccaggggcatttcgtggggtcggactggcagcagaatagtgtggtaatctgtgatgggctgggccaggtggttgggggagtacaaggggccangcctgcatggctggcanccgggcttcctgtctggggataaaaaggctacttctttctgacccttcnaaaaatcaaacagggggggatcctggaacccaaggggtccctccctggaaaatttctgaaancctacacgggcctggaaaacccccggggtacccccatgggggatggnaggnaactggnnnngnccctcnnnaangggaacacccaacttttcngggccnttccccn

SEQ ID NO: 283 - DNA, 1104 bp, Human
  misc_feature (762)..(762): n is a, c, g, or t
  misc_feature (780)..(780): n is a, c, g, or t
  misc_feature (821)..(821): n is a, c, g, or t
  misc_feature (838)..(838): n is a, c, g, or t
  misc_feature (845)..(845): n is a, c, g, or t
  misc_feature (871)..(871): n is a, c, g, or t
  misc_feature (878)..(878): n is a, c, g, or t
  misc_feature (900)..(900): n is a, c, g, or t
  misc_feature (919)..(919): n is a, c, g, or t
  misc_feature (985)..(985): n is a, c, g, or t
  misc_feature (988)..(988): n is a, c, g, or t
  misc_feature (996)..(996): n is a, c, g, or t
  misc_feature (1008)..(1009): n is a, c, g, or t
  misc_feature (1011)..(1011): n is a, c, g, or t
  misc_feature (1013)..(1014): n is a, c, g, or t
  misc_feature (1017)..(1017): n is a, c, g, or t
  misc_feature (1025)..(1026): n is a, c, g, or t
  misc_feature (1041)..(1042): n is a, c, g, or t
  misc_feature (1055)..(1056): n is a, c, g, or t
  misc_feature (1059)..(1059): n is a, c, g, or t
  misc_feature (1069)..(1069): n is a, c, g, or t
  misc_feature (1077)..(1078): n is a, c, g, or t
  misc_feature (1089)..(1089): n is a, c, g, or t
  misc_feature (1100)..(1100): n is a, c, g, or t
  misc_feature (1102)..(1103): n is a, c, g, or t
tagagaaattaactatgagaggatcgcatcaccatcaccatcacggatcctatttaggtgacactatagaatcgtcgacccacgcgtccgcccacgcgtccgcggacgcgtgggtccggagctcggcggtggcgccggaggaggctgcagcggcggcggcggcgggcccggacgagcgtccggaggtggcggacgaggcgccgggggcccccatgggcgggtgtgtgggcgcccagcacgactcctcgggcagcctcaacgagaactcggagggcaccggagttgctctaggtcgtaaccagcctttgaaaaaggagaaaccaaaatggaaaagcgattatcctatgacagatggacaactacgcagcaagagggatgaattttgggatacagcaccagcttttgaaggccggaaagagatttgggatgccttgaaggctgctgcacatgcttttgagagcaatgatcatgaactggcacaagcaatcattgatggtgcaaacataacattaccacatggtgcacttacagagtgctacgatgaactggggaacagatatcagcttccagtgtattgcttggcaccgccaatcaacatgatagaggaaaagagcgacatagagactctggatattcctgagccaccacccaattctggatatgaatgtcagcttcgtttgcgcctttccacaggcaaagacctcaagcttgtggttcgcagcacagacacagtattccacatgaagagacggttgcatgcancaaaagggagtggaaacnagggtagtcagccggtggttttttttctggcagacctctcnctgacaaaatgaagttncgaaganctgaagatccccaaaggactatgttngtacagnttatagtggagccaaccttgtngccagaacccaaccaccanttgaaaaaactgaactgaaccccctgtttgggccaacttcccacatccctctggctcctttttaanggntcttggtngcattttcccanncngnnggnggggaaanntaatttccctgcctnnaaatttccctaannaanggaattttanttctgaannattacccgttnaaaattctttntnng

SEQ ID NO: 284 - DNA, 840 bp, Human
  misc_feature (662)..(662): n is a, c, g, or t
gagagatactatgagaggtcgcatcccatcaccatcacggatcctatttaggtgacactatagaatcgtcgactctggaccttggctgtcactcagttacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagaaagaagcagcagtcaggaagacagatgtgaagagctggagcatgttcagatgagaggagacggaacacggggacacaccagcttgagcaagggacaacaggggaggactgatgactgacttcccacctttgaggtgctaatgtgtgtgtggtggcactggataaaagatcaatgttgactaggcaccatggcacacgcctgtagtcccagccactctggaggctaaggcgggaggattgcttgagcccagaagttggaggctgctatgagccgtgatcatgccactgcactccagcaacctgngcaacagagtgagaccctgtctcaaaaaaaaaaaaaatgaaaagtccacataacctgagcatcatgtgcccagagcgttgggtggtgtggtcccattcttcttccagcggctcttctggccactcaatgtcagatgtcctgctcactatcataccataaaacctgacttcttccctgc

SEQ ID NO: 285 - DNA, 870 bp, Human
  misc_feature (705)..(705): n is a, c, g, or t
  misc_feature (783)..(783): n is a, c, g, or t
  misc_feature (844)..(845): n is a, c, g, or t
agagagatactatgagaggacgcatcaccatcaccatcacggatcctatttaggtgacactatagaatcgtcgactctggaccttggctgtcactcagtttttgatcatcttgtggtagagagaagtgacgatggctcttttcatatcagagattctcacatgcttaacactggaaatgatttgaaagaaaatgtcaaaagcgattcagtgctgctgaccagtggaaagtatgatctgaagaaacaacgcagtgtcacgcaagccactcagacaagcccaggggttccttggccttctcagtcagctaactttcctgagttctcctttgacttcactagggaacagctcatggaagagaatgaatctcttaaacaggaactggctaaagctaaaatggctcttgcagaggctcacttggaaaaagatgctcttcttcatcatataaagaagatgacagttgaatagcaggagtggcagtcaaaactgaaattatagctctggagtaggaaggttatatttataatgtggatgttaccagttaggggaagacttttattttcatgaaaagacaataaaacaaaatggaatgtgatgaagtggtgactatttcaaagccagtttagaaagtattagtacgggcattacaatcttttggttgttttgtgttttggggcttaaccctcttttaagctgttgtgatctanggaagtcaacacatagtgtaaaataattacatgcctaatgaaaagagatgtcatttcctattttgatatctcatttcngcattttttaaatgtaaaaggaaaacctctgtgtcacacagatgctgaatgatttctcatnnttgtataattactatattacaagat

SEQ ID NO: 286 - DNA, 1376 bp, Human
  misc_feature (12)..(12): n is a, c, g, or t
  misc_feature (848)..(848): n is a, c, g, or t
  misc_feature (870)..(870): n is a, c, g, or t
  misc_feature (895)..(895): n is a, c, g, or t
  misc_feature (910)..(910): n is a, c, g, or t
  misc_feature (936)..(936): n is a, c, g, or t
  misc_feature (948)..(948): n is a, c, g, or t
  misc_feature (974)..(974): n is a, c, g, or t
  misc_feature (995)..(995): n is a, c, g, or t
  misc_feature (997)..(997): n is a, c, g, or t
  misc_feature (1002)..(1002): n is a, c, g, or t
  misc_feature (1004)..(1004): n is a, c, g, or t
  misc_feature (1006)..(1006): n is a, c, g, or t
  misc_feature (1012)..(1012): n is a, c, g, or t
  misc_feature (1032)..(1032): n is a, c, g, or t
  misc_feature (1053)..(1053): n is a, c, g, or t
  misc_feature (1064)..(1064): n is a, c, g, or t
  misc_feature (1093)..(1093): n is a, c, g, or t
  misc_feature (1097)..(1097): n is a, c, g, or t
  misc_feature (1101)..(1101): n is a, c, g, or t
  misc_feature (1145)..(1145): n is a, c, g, or t
  misc_feature (1150)..(1150): n is a, c, g, or t
  misc_feature (1153)..(1153): n is a, c, g, or t
  misc_feature (1164)..(1165): n is a, c, g, or t
  misc_feature (1181)..(1181): n is a, c, g, or t
  misc_feature (1186)..(1186): n is a, c, g, or t
  misc_feature (1197)..(1197): n is a, c, g, or t
  misc_feature (1202)..(1203): n is a, c, g, or t
  misc_feature (1206)..(1206): n is a, c, g, or t
  misc_feature (1210)..(1210): n is a, c, g, or t
  misc_feature (1219)..(1219): n is a, c, g, or t
  misc_feature (1224)..(1224): n is a, c, g, or t
  misc_feature (1226)..(1226): n is a, c, g, or t
  misc_feature (1231)..(1231): n is a, c, g, or t
  misc_feature (1255)..(1255): n is a, c, g, or t
  misc_feature (1261)..(1261): n is a, c, g, or t
  misc_feature (1266)..(1266): n is a, c, g, or t
  misc_feature (1270)..(1270): n is a, c, g, or t
  misc_feature (1272)..(1272): n is a, c, g, or t
  misc_feature (1287)..(1289): n is a, c, g, or t
  misc_feature (1307)..(1308): n is a, c, g, or t
  misc_feature (1330)..(1330): n is a, c, g, or t
  misc_feature (1335)..(1335): n is a, c, g, or t
  misc_feature (1338)..(1338): n is a, c, g, or t
  misc_feature (1361)..(1361): n is a, c, g, or t
tagagaaattanctatgagaggatcgcatcaccatcaccatcacggatcctatttaggtgacactatagaatcgtcgacccacgcgtccgggagtacaagttcagtggacagtgatattcttagctccagtcatagcagtgatactttgtgcaatgcagacaatgctcagatccctttggctaatggacttgactctcacagtatcacaagtagtagaagaacgaaagcaaatgaagggaaaaaagaaacatgggatacagcagaagaagactctggaactgatagtgaatatgatgagagtggcaagagtaggggagaaatgcagtacatgtatttcaaagctgaaccttatgctgcagatgaaggttctggggaaggacataaatggttgatggtgcatgttgataaaagaattactctggcagctttcaaacaacatttagagccctttgttggagttttgtcctctcacttcaaggtctttcgagtgtatgccagcaatcaagagtttgagagcgtccggctgaatgagacactttcatcattttctgatgacaataagattacaattagactggggagagcacttaaaaaaggagaatacagagttaaagtataccagcttttggtcaatgaacaagagccatgcaagtttctgctagatgctgtgtttgctaaaggaatgactgtacggcaatcaaaagaggaattaattcctcagctcagggagcaatgtggtttaaagctcagtattgacaggtttcgtctaaggaaaaaaaacatggaagaatcctggccactgtctttttggattatcatatttatgaagaagatattaatatttccngccaactgggaaggtttccctngaagttcttgatggggtaaaaaaanatgaagtccatgtcncaccttgcagtttttgtcaaaacggnggaaacccttcnaaaaatgaagttggaatcccttcccnggaaggttgttattggaaaancnattantngnggaacnaatttgccaaaaaaaccttnaatgaaattccagggggaatnccttttgggangaaatttgaatttgcccaaggggaaaagnaacntttnccccgggaaaatttccggcccctgaaaattccccccaaaatttnaaccnggnaacccctaaannttccccccccggaaanggccngggcccctttnattcnnggnaagnaggggggcngcccnanttttnagggggaaaaaaccaaaaaaattnttgggnccctncccnantaccccaaaaaattnnncctgggaaaaaaaaaaanncctcccccccccaaaaaagggnacccnggnaaaaacccccccccaaaaaaaancccctaaaattttgg

SEQ ID NO: 287 - DNA, 1104 bp, Human
  misc_feature (1)..(2): n is a, c, g, or t
  misc_feature (801)..(801): n is a, c, g, or t
  misc_feature (830)..(830): n is a, c, g, or t
  misc_feature (864)..(864): n is a, c, g, or t
  misc_feature (873)..(873): n is a, c, g, or t
  misc_feature (943)..(943): n is a, c, g, or t
  misc_feature (966)..(966): n is a, c, g, or t
  misc_feature (972)..(972): n is a, c, g, or t
  misc_feature (977)..(977): n is a, c, g, or t
  misc_feature (995)..(995): n is a, c, g, or t
  misc_feature (1006)..(1007): n is a, c, g, or t
  misc_feature (1026)..(1026): n is a, c, g, or t
  misc_feature (1029)..(1029): n is a, c, g, or t
  misc_feature (1042)..(1042): n is a, c, g, or t
  misc_feature (1044)..(1044): n is a, c, g, or t
  misc_feature (1053)..(1053): n is a, c, g, or t
  misc_feature (1059)..(1060): n is a, c, g, or t
  misc_feature (1062)..(1062): n is a, c, g, or t
  misc_feature (1065)..(1065): n is a, c, g, or t
  misc_feature (1067)..(1067): n is a, c, g, or t
  misc_feature (1073)..(1074): n is a, c, g, or t
  misc_feature (1076)..(1076): n is a, c, g, or t
  misc_feature (1078)..(1078): n is a, c, g, or t
  misc_feature (1080)..(1080): n is a, c, g, or t
  misc_feature (1084)..(1084): n is a, c, g, or t
  misc_feature (1088)..(1088): n is a, c, g, or t
  misc_feature (1092)..(1092): n is a, c, g, or t
  misc_feature (1098)..(1098): n is a, c, g, or t
nntagagaaattactatgagaggatcgcatcaccatcaccatcacggatcctatttaggtgacactatagaatcgtcgacccacgcgtccggctgtgcgctctcgtcgggagtcccagccatgtccgacgagagagaggtagccgaggcagcgaccggggaagacgcctcttcgccgcctccgaaaaccgaggcagcgagcgacccccagcatcccgcggcctccgaaggggccgccgccgccgccgcctcgccgccactgctgcgctgcctagtgctcaccggctttggaggctacgacaaggtgaagctgcagagccggccggcagcgcccccggcccctgggcccggccagctgacgctgcgtctgcgggcctgcgggctcaacttcgcagacctcatggctaggcaggggctgtacgaccgtctcccgcctctgcctgtcactccgggcatggagggcgcgggtgttgtgatcgcagtgggcgagggagtcagcgaccgcaaggcaggagaccgggtgatggtgttgaaccggtcagggatgtggcaggaagaggtgactgtgccctcggtccagaccttcctgattcctgaggccatgacctttgaggaagctgctgccttgctcgtcaattacattacagcctacatggtcctctttgacttcggcaacctacagcctggccacagcgtcttggtacacatggctgcagggggtgtgggtatggctgccgtgcagctgtgccgtacagtggagaatgtgacagtgttcggaacggcctcggccagcaagcacgangcactgaaggagaatggggtcacacatcncatcgactatcacacgactgactacgtggatganatcaagaanatttcccctaaaggagtggacattgtcatggaccctctgggtgggtcaaatattgccaagggctacaacntcctgaaacccatgggcaaatcnttcacntatgnaatggccaacttgctgangggccccaaanngaaacctgatggccctggnccngaaatggtggaantnatttaacgngaaaanntntgnanttgctnnangncnaacngggntttntttggnttccac

SEQ ID NO: 288 - DNA, 1150 bp, Human
  misc_feature (1)..(1): n is a, c, g, or t
  misc_feature (5)..(5): n is a, c, g, or t
  misc_feature (863)..(863): n is a, c, g, or t
  misc_feature (881)..(881): n is a, c, g, or t
  misc_feature (888)..(888): n is a, c, g, or t
  misc_feature (900)..(900): n is a, c, g, or t
  misc_feature (941)..(941): n is a, c, g, or t
  misc_feature (949)..(949): n is a, c, g, or t
  misc_feature (957)..(957): n is a, c, g, or t
  misc_feature (961)..(961): n is a, c, g, or t
  misc_feature (968)..(968): n is a, c, g, or t
  misc_feature (976)..(976): n is a, c, g, or t
  misc_feature (985)..(985): n is a, c, g, or t
  misc_feature (989)..(989): n is a, c, g, or t
  misc_feature (995)..(995): n is a, c, g, or t
  misc_feature (1023)..(1023): n is a, c, g, or t
  misc_feature (1031)..(1031): n is a, c, g, or t
  misc_feature (1037)..(1037): n is a, c, g, or t
  misc_feature (1071)..(1071): n is a, c, g, or t
  misc_feature (1075)..(1075): n is a, c, g, or t
  misc_feature (1077)..(1077): n is a, c, g, or t
  misc_feature (1089)..(1089): n is a, c, g, or t
  misc_feature (1101)..(1101): n is a, c, g, or t
  misc_feature (1104)..(1106): n is a, c, g, or t
  misc_feature (1116)..(1116): n is a, c, g, or t
  misc_feature (1119)..(1120): n is a, c, g, or t
  misc_feature (1122)..(1122): n is a, c, g, or t
  misc_feature (1124)..(1124): n is a, c, g, or t
  misc_feature (1126)..(1126): n is a, c, g, or t
  misc_feature (1133)..(1133): n is a, c, g, or t
  misc_feature (1143)..(1143): n is a, c, g, or t
  misc_feature (1146)..(1146): n is a, c, g, or t
naatngagaaattactatgagaggatcgcatcaccatcaccatcacggatcctatttaggtgacactatagaatcgtcgacccacgcgtccgtaccttttctggaggaatcaccttgtggaagccaaatctcttcagaacattcggtcattaagccacctcttggagattctccagggagtctttcaaggtcgaaaggggaagaggatgacaaatcaaaaaagcagtttgtttgtattaatatcctagaagacacacaagctgttagagcagtggcttttcatccagctggaggtttatatgctgttggttcaaattcaaaaactctgagagtatgtgcctatccagatgtaattgatccaagtgcacatgagactcctaagcagccggtggtacgttttaaaaggaataaacatcataaaggatccatttactgtgtggcctggagtccttgtgggcagttattagcaacaggatcaaatgacaaatacgtcaaagtgctgcccttcaatgcagagacttgtaacgcaacaggaccagatctggaatttagtatgcatgatggaacaattagagacttggcatttatggaaggcccagaaagcggaggagctattttaataagtgctggagcaggggattgtaacatttatacaaccgattgtcaaagaggacagggcctccatgctttgagtggacatactgggcatattttagcactttatacctggagtggctggatgattgcatctggttcccaagataagactgttagattttgggatcttcgagtaccaagttgtgttcgtgttgttggcacaacatttcatggaactggcagtgcagtggcatctgtagctgtanatcccagtggtcgtctcnttagccncaggtcaagaanaattctagctgcatgttgtatgacttaagaggaggaagaanggtacaangttatcancccnttccagngatgttcnctctgttcnatcncccccnggacctccctacttgctaaaagggctcnttatgaantgaaantaaggggaaaagacctacaaggggaacccccccnagcnancttccttatccngggggggggggnaannnaaggacaaanggnntncngnggcaaanggccccccanaantttt

SEQ ID NO: 289 - DNA, 1182 bp, Human
  misc_feature (6)..(6): n is a, c, g, or t
  misc_feature (797)..(797): n is a, c, g, or t
  misc_feature (928)..(928): n is a, c, g, or t
  misc_feature (938)..(938): n is a, c, g, or t
  misc_feature (949)..(949): n is a, c, g, or t
  misc_feature (952)..(952): n is a, c, g, or t
  misc_feature (1001)..(1001): n is a, c, g, or t
  misc_feature (1006)..(1006): n is a, c, g, or t
  misc_feature (1014)..(1014): n is a, c, g, or t
  misc_feature (1018)..(1018): n is a, c, g, or t
  misc_feature (1027)..(1027): n is a, c, g, or t
  misc_feature (1033)..(1034): n is a, c, g, or t
  misc_feature (1037)..(1037): n is a, c, g, or t
  misc_feature (1041)..(1041): n is a, c, g, or t
  misc_feature (1060)..(1060): n is a, c, g, or t
  misc_feature (1070)..(1070): n is a, c, g, or t
  misc_feature (1089)..(1089): n is a, c, g, or t
  misc_feature (1093)..(1094): n is a, c, g, or t
  misc_feature (1099)..(1099): n is a, c, g, or t
  misc_feature (1103)..(1103): n is a, c, g, or t
  misc_feature (1111)..(1111): n is a, c, g, or t
  misc_feature (1113)..(1113): n is a, c, g, or t
  misc_feature (1121)..(1121): n is a, c, g, or t
  misc_feature (1123)..(1123): n is a, c, g, or t
  misc_feature (1127)..(1127): n is a, c, g, or t
  misc_feature (1138)..(1138): n is a, c, g, or t
  misc_feature (1147)..(1147): n is a, c, g, or t
  misc_feature (1159)..(1160): n is a, c, g, or t
  misc_feature (1172)..(1172): n is a, c, g, or t
  misc_feature (1178)..(1179): n is a, c, g, or t
  misc_feature (1182)..(1182): n is a, c, g, or t
tagagnaattactatgagaggatcgcatcaccatcaccatcacggatcctatttaggtgacactatagaatcgtcgacccacgcgtccgcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcanagagcgaacttgtcatagatttaggagaagaccattctggggcggggagggtcgaaaaaataagaaggaacccaaagaaccatctcccaaacaggatggttgtaggtaaaactccaccatccacgacgggnggggcagccnttctccccggnaancacgggtgctcacccgctcttccgcccaaacttccgggggtggggccanagccncccaccangcangtcctccangggtcnncgntcangggcccgggcccccgccgncccagggaanccccagggaaaaaccaaanggcnnttttncccnaaggaaangncccggccngncacngggtcgggggnaacttttcnagtaatttttanngccccccaaaanggggcnntgn

SEQ ID NO: 290 - DNA, 1211 bp, Human
  misc_feature (7)..(7): n is a, c, g, or t
  misc_feature (796)..(796): n is a, c, g, or t
  misc_feature (803)..(803): n is a, c, g, or t
  misc_feature (931)..(931): n is a, c, g, or t
  misc_feature (949)..(949): n is a, c, g, or t
  misc_feature (958)..(958): n is a, c, g, or t
  misc_feature (964)..(964): n is a, c, g, or t
  misc_feature (969)..(969): n is a, c, g, or t
  misc_feature (974)..(974): n is a, c, g, or t
  misc_feature (981)..(981): n is a, c, g, or t
  misc_feature (984)..(984): n is a, c, g, or t
  misc_feature (994)..(994): n is a, c, g, or t
  misc_feature (1000)..(1000): n is a, c, g, or t
  misc_feature (1004)..(1004): n is a, c, g, or t
  misc_feature (1019)..(1019): n is a, c, g, or t
  misc_feature (1023)..(1024): n is a, c, g, or t
  misc_feature (1040)..(1040): n is a, c, g, or t
  misc_feature (1048)..(1048): n is a, c, g, or t
  misc_feature (1069)..(1070): n is a, c, g, or t
  misc_feature (1080)..(1080): n is a, c, g, or t
  misc_feature (1086)..(1086): n is a, c, g, or t
  misc_feature (1089)..(1089): n is a, c, g, or t
  misc_feature (1103)..(1104): n is a, c, g, or t
  misc_feature (1112)..(1112): n is a, c, g, or t
  misc_feature (1120)..(1121): n is a, c, g, or t
  misc_feature (1123)..(1123): n is a, c, g, or t
  misc_feature (1126)..(1126): n is a, c, g, or t
  misc_feature (1130)..(1130): n is a, c, g, or t
  misc_feature (1143)..(1143): n is a, c, g, or t
  misc_feature (1146)..(1146): n is a, c, g, or t
  misc_feature (1151)..(1151): n is a, c, g, or t
  misc_feature (1156)..(1156): n is a, c, g, or t
  misc_feature (1162)..(1163): n is a, c, g, or t
  misc_feature (1168)..(1168): n is a, c, g, or t
  misc_feature (1176)..(1176): n is a, c, g, or t
  misc_feature (1181)..(1181): n is a, c, g, or t
  misc_feature (1184)..(1184): n is a, c, g, or t
  misc_feature (1192)..(1192): n is a, c, g, or t
  misc_feature (1200)..(1200): n is a, c, g, or t
  misc_feature (1202)..(1202): n is a, c, g, or t
  misc_feature (1211)..(1211): n is a, c, g, or t
tagaggnaattactatggagaggatcgcatcaccatcaccatcacgggatcctatttaggtgacactatagaatcgtcgacccacgcgtccgctcttactgaacataagataattcatactggagagaaaccctacaaatgtgaagaatgtggcaaagcatttagccaatcctcaaccctaactagacatacgaggatgcacactggagagaaaccatacaaatgtgaagaatgtggcaaagcttttaatcgatcctcaaagcttactacacataagataattcatactggagagaaaccttacaagtgtgaagaatgtggcaaagcatttatatcatcctcaaccctaaatggacataagagaattcatactagagagaaaccctacaaatgtgaagaatgtggcaaagcatttagccaatcttcaaccctaactagacataagaggttgcacaccggagagaaaccctacaaatgtggagaatgtggcaaagcctttaaagagtcctcagctcttactaaacataagataattcacactggagagaaaccctacaaatgtgaaaaatgtggcaaagcctttaaccagtcttcaatccttactaaccataagaaaattcatactatcacacctgtaatcccagcactttgggaggccgaggcgggcggatcacgaggtcaggagatggagaccatcctggctaacacagtgaaaccccttctctactaaaaaatacaaaaaattagccgggcgtggtggcgggcgcctgtagtcccagctatgcgagaggctgangcagganaatggcgtgaacccgggaggcggagcttgcagtgagccgagatcacgccactgcactcaagcctgggcgacagagcgagactccgtctcaaaaaaaaaaaaaagaaaattcctactagagagaacccntacaaatataaagaatgnggcaaatcnttttancgggncttcnacctttnctnaacataaggnaattcntacnggaattaaactctanaatnnggaaaaagggggcaancctttttncgggccccccccctacccganntaaaaaaatncttccnggncagcaccctacaanngggaaaanttggcaanncnttnaccngttttcccccttnctncgaanaaaanaccccnntgggnaaaaaacnttaanggngggaaaangggggaangncttaaaaan

SEQ ID NO: 291 - DNA, 788 bp, Human
  misc_feature (723)..(723): n is a, c, g, or t
ctatagagaaatactatgagaggatgcatcccatcaccatcacggatcctatttaggtgacactatagaatcgtcgactctggaccttggctgtcactcagttactggagagaaaccatatacatgtaaacagtgtgggaaagccttcagtgtttccagttcccttcgaagacatgaaaccactcacagtgcagagaaaccctatgagtgtaagcaatgcgggaaaacatttcatcatcttggaagctttcagatacacatgaaaaggcacactggagatcgacctcataaatgtaagatatgtgggaaaggctttgatcgtcccagtttagttcgatatcatgaacgaattcacactggagagaaaccctatgaatgcaagcagtgtgggaaaacgttatctcatagctcaagctttcgaagacacatgataatgcacactggaggtggacctcataaatgcaagatatgtgggaaagcttttgtttatcctagtgtatgtcaaagacacgaaaagtctcacagtggagagaaaccctatgaatgcaagcagtgtgggaaagcgttatctcatagctcaagctttcgaagacatatggtaatgcatacgggagatgggccgaataaatgcaaggtatgtgggaaagcctttgtttatcccagtgtatgtcaaagacatgaaaagactcactggagagaaacaatatgaatggtaactattantaagccttctatatttccagttccctttgatatcatgaataaacttacactggacagaaacccct

SEQ ID NO: 292 - DNA, 1063 bp, Human
  misc_feature (1)..(1): n is a, c, g, or t
  misc_feature (4)..(4): n is a, c, g, or t
  misc_feature (774)..(774): n is a, c, g, or t
  misc_feature (797)..(798): n is a, c, g, or t
  misc_feature (803)..(803): n is a, c, g, or t
  misc_feature (817)..(817): n is a, c, g, or t
  misc_feature (831)..(831): n is a, c, g, or t
  misc_feature (833)..(833): n is a, c, g, or t
  misc_feature (838)..(838): n is a, c, g, or t
  misc_feature (840)..(840): n is a, c, g, or t
  misc_feature (846)..(846): n is a, c, g, or t
  misc_feature (862)..(862): n is a, c, g, or t
  misc_feature (871)..(871): n is a, c, g, or t
  misc_feature (875)..(875): n is a, c, g, or t
  misc_feature (880)..(880): n is a, c, g, or t
  misc_feature (884)..(884): n is a, c, g, or t
  misc_feature (890)..(890): n is a, c, g, or t
  misc_feature (895)..(895): n is a, c, g, or t
  misc_feature (905)..(905): n is a, c, g, or t
  misc_feature (913)..(914): n is a, c, g, or t
  misc_feature (920)..(920): n is a, c, g, or t
  misc_feature (923)..(923): n is a, c, g, or t
  misc_feature (933)..(933): n is a, c, g, or t
  misc_feature (939)..(939): n is a, c, g, or t
  misc_feature (946)..(946): n is a, c, g, or t
  misc_feature (950)..(950): n is a, c, g, or t
  misc_feature (957)..(958): n is a, c, g, or t
  misc_feature (969)..(969): n is a, c, g, or t
  misc_feature (972)..(973): n is a, c, g, or t
  misc_feature (975)..(976): n is a, c, g, or t
  misc_feature (990)..(990): n is a, c, g, or t
  misc_feature (993)..(994): n is a, c, g, or t
  misc_feature (998)..(998): n is a, c, g, or t
  misc_feature (1029)..(1029): n is a, c, g, or t
  misc_feature (1038)..(1039): n is a, c, g, or t
  misc_feature (1043)..(1043): n is a, c, g, or t
  misc_feature (1050)..(1050): n is a, c, g, or t
  misc_feature (1056)..(1057): n is a, c, g, or t
naantagagaaattactatgagaggatcgcatcaccatcaccatcacggatcctatttaggtgacactatagaatcgtcgacccacgcgtccgccccttccctctctcccctgtcctctctctccgggctcccaccgccgccgcgggccggggagccaccggccgccaccatgagttccttcagctacgagccgtactactcgacctcctacaagcggcgctacgtggagacgccccgggtgcacatctccagcgtgcgcagcggctacagcaccgcacgctcagcttactccagctactcggcgccggtgtcttcctcgctgtccgtgcgccgcagctactcctccagctctggatcgttgatgcccagtctggagaacctcgacctgagccaggtagccgccatcagcaacgacctcaagtccatccgcacgcaggagaaggcgcagctccaggacctcaatgaccgcttcgccagcttcatcgagcgcgtgcacgagctggagcagcagaacaaggtcctggaagccgagctgctggtgctgcgccagaagcactccgagccatcccgcttccgggcgctgtacgagcaggagatccgcgacctgcgcctggcggcggaagatgccaccaacgagaagcaggcgctccagggcgagcgcgaagggctggaggagaccctgcgcaacctgcaggcgcgctatgaaaaggaagtgctgaaccgcgaggacgccgaaggccgggctgatggaagcgcgcaaaaggcgccgaacnaggcggcgctcgctcgcgccganntcganaaagcgcattcaanagcttgaatgggangnaaatntntttttntgaaaaaaagtggacnaagaagaanaatngcccnaaanttgganggcgnaaaattccantaaggcgnnaaaatnttncgggggaaangggaanttgaaanaagncccgaanntttttccgccnggnntnnaaaggaaatccccnccnnaaanaaaaaaaaaacttggcccccaaaaaaaaatngcaaaaatnncttnaagaaangggttnnaaaaaa

SEQ ID NO: 293 - DNA, 1143 bp, Human
  misc_feature (824)..(824): n is a, c, g, or t
  misc_feature (910)..(910): n is a, c, g, or t
  misc_feature (924)..(924): n is a, c, g, or t
  misc_feature (953)..(953): n is a, c, g, or t
  misc_feature (955)..(955): n is a, c, g, or t
  misc_feature (965)..(965): n is a, c, g, or t
  misc_feature (987)..(987): n is a, c, g, or t
  misc_feature (994)..(994): n is a, c, g, or t
  misc_feature (997)..(997): n is a, c, g, or t
  misc_feature (1005)..(1005): n is a, c, g, or t
  misc_feature (1010)..(1010): n is a, c, g, or t
  misc_feature (1015)..(1015): n is a, c, g, or t
  misc_feature (1034)..(1035): n is a, c, g, or t
  misc_feature (1042)..(1042): n is a, c, g, or t
  misc_feature (1056)..(1056): n is a, c, g, or t
  misc_feature (1062)..(1062): n is a, c, g, or t
  misc_feature (1065)..(1065): n is a, c, g, or t
  misc_feature (1068)..(1068): n is a, c, g, or t
  misc_feature (1071)..(1071): n is a, c, g, or t
  misc_feature (1080)..(1080): n is a, c, g, or t
  misc_feature (1084)..(1085): n is a, c, g, or t
  misc_feature (1089)..(1089): n is a, c, g, or t
  misc_feature (1095)..(1095): n is a, c, g, or t
  misc_feature (1105)..(1105): n is a, c, g, or t
  misc_feature (1118)..(1118): n is a, c, g, or t
  misc_feature (1130)..(1130): n is a, c, g, or t
  misc_feature (1133)..(1133): n is a, c, g, or t
  misc_feature (1136)..(1136): n is a, c, g, or t
  misc_feature (1141)..(1143): n is a, c, g, or t
attagagaaattactatgagaggatcgcatcaccatcaccatcacggatcctatttaggtgacactatagaatcgtcgacccacgcgtccgcgtcctacaaatatgaagcagacacggtggacctgaattggtgcgtcatttccgacatggaagtcatcgagctgaacaaatgcacctcgggccaatcctttgaagtcatcctgaagccaccctcctttgatggggttcccgagttcaacgcctccctgccaaggcggcgagacccatccctggaagagatccagaagaaactagaagcggctgaggagcgaaggaagtaccaggaagcggagctcctgaaacacctagcagagaaacgggaacatgagagagaggtgatccaaaaggccattgaggaaaacaacaacttcatcaagatggctaaggaaaaactggcccagaagatggaatccaacaaggagaacagggaggcccacctcgccgccatgttggaacggctgcaagagaaggacaagcacgccgaggaggtgcggaaaaacaaggagctgaaggaagaggcctccaggtaaagcctagaggccaaagaactttccaggtcagccggacagctccagcagctccacgttccaggcagcctcgcccgccggctgcgctcccagcactggggtttggggggaggggggtggccaaggggcgtttcctctgcttttggtgtttgtacatgttaagaattgaccagtgaagccatcctatttgtttccggggaacaatgacggggtgggagaggggagaggagagagtttgggaaagggagatggagaanaactcaaggacattgcaaccctgcccggcgcaaatctgattttcacatctctacctggacattgagcctccaggcaccatgttganggaaagatgaaaanccaggggcggttaaaacttcagggtgaangnaaaaagtccntgggtggggcaacggctggcangggcccnccnaaaaaaancccancccanaggggggggtgaagtaccnngtggggnttgctttccccccntgccancanggnggnaataaggtntggnnttgngggggngaaaccatcntttttttgattcntcctggaccaantgnaanctttnnn

SEQ ID NO: 294 - DNA, 1332 bp, Human
atgaaggaggacgagccgtggtacgaccaccaggacctccagcaagatcttcaacttgctgctgagcttgggaagacattactggatcggaacacagagttggaggactctgttcagcagatgtatacaaccaatcaggagcagttacaggaaattgagtatctgacgaagcaagtggaacttctacggcagatgaacgaacaacatgcaaaggtttatgaacaattagacgtcacagcaagggaactggaagaaacaaatcaaaagctagttgctgacagcaaggcctcacagcaaaagattctgagcctgactgaaacgattgaatgcctgcaaaccaacattgatcacctccagagccaagtggaggagctgaagtcatctggccaagggagaaggagcccgggaaagtgtgaccaggagaaaccggcacccagctttgcatgtctgaaggagctgtatgacctccgccaacacttcgtgtatgatcatgtgttcgctgagaagatcacttccttgcaaggtcagccaagccctgatgaagaggaaaatgagcacttgaaaaaaacagtgacaatgttgcaggcccagctgagcctggagcggcagaagcgggtgactatggaggaggaatatgggctcgtgttaaaggagaacagtgaactggagcagcagctgggggccacaggtgcctaccgagcacgggcgctggaactagaggccgaggtggcagagatgcgacagatgttgcagtcagagcatccatttgtgaatggagttgagaagctggtgccagactctctgtatgttcctttcaaagagcccagccagagcctgctggaagagatgttcctgactgtgccggaatcacatagaaagcctctcaagcgcagcagcagtgagacgatcctcagcagcttggcagggagtgacatcgtgaagggccacgaggagacctgcatcaggagggccaaggctgtgaaacagaggggcatctcccttctgcacgaagtggacacgcagtacagcgccctgaaggtgaagtatgaagagttgctgaagaagtgccaagaggaacaggactccctgtcacacaaggctgtgcagacctccagggctgcagccaaggacctgactggagtgaacgcccagtctgagcctgttgccagcggctgggaactggcctctgtcaacccagagcccgtgagttcccctacaacacctccagaatacaaagcgttgtttaaggagatctttagttgcatcaagaaaactaagcaggaaatagatgaacagagaacaaaataccgatcactctcctctcattcttaa

SEQ ID NO: 295 - DNA, 1168 bp, Human
  misc_feature (852)..(852): n is a, c, g, or t
  misc_feature (892)..(892): n is a, c, g, or t
  misc_feature (924)..(924): n is a, c, g, or t
  misc_feature (926)..(926): n is a, c, g, or t
  misc_feature (932)..(932): n is a, c, g, or t
  misc_feature (962)..(962): n is a, c, g, or t
  misc_feature (967)..(967): n is a, c, g, or t
  misc_feature (972)..(972): n is a, c, g, or t
  misc_feature (1040)..(1040): n is a, c, g, or t
  misc_feature (1045)..(1045): n is a, c, g, or t
  misc_feature (1049)..(1049): n is a, c, g, or t
  misc_feature (1052)..(1052): n is a, c, g, or t
  misc_feature (1055)..(1056): n is a, c, g, or t
  misc_feature (1059)..(1059): n is a, c, g, or t
  misc_feature (1070)..(1070): n is a, c, g, or t
  misc_feature (1073)..(1073): n is a, c, g, or t
  misc_feature (1108)..(1109): n is a, c, g, or t
  misc_feature (1112)..(1113): n is a, c, g, or t
  misc_feature (1118)..(1119): n is a, c, g, or t
  misc_feature (1122)..(1122): n is a, c, g, or t
  misc_feature (1132)..(1132): n is a, c, g, or t
  misc_feature (1134)..(1134): n is a, c, g, or t
  misc_feature (1152)..(1152): n is a, c, g, or t
  misc_feature (1160)..(1160): n is a, c, g, or t
agagaaattactatgagaggatcgcatcaccatcaccatcacggatcctatttaggtgacactatagaatcgtcgacccacgcgtccggcccggcaatggcggcctcgacggcctcgcaccggcccatcaaggggatcttgaagaacaagacctctacgacttcctctatggtggcgtcggccgaacagccccgcgggaatgtcgacgaggagctgagcaaaaaatcccagaagtgggatgaaatgaacatcttggcgacgtatcatccagcagacaaagactatggtttaatgaaaatagatgaaccaagcactccttaccatagtatgatgggggatgatgaagatgcctgtagtgacaccgaggccactgaagccatggcgccagacatcttagccaggaaaaaaaaagcgacaatttgaaatgaaaaggaagcttcactacaatgaaggactcaatatcaaactagccagacaattaatttcaaaagacctacatgatgatgatgaagatgaagaaatgttagagactgcagatggagaaagcatgaatacggaagaatcaaatcaaggatctactccaagtgaccaacagcaaaacaaattacgaagttcatagacgagatttgttcaacactgcaattgtttgttagatgtaaaccctgtgactatagtacgttgcttcttgttcttcacaattcatgacttaagtaccaaaatgcataccagttattatatattgccaagaattaaatgataaacttagagactgattagactgaaaatgcctaatcgatatatatattcttgtgcctagtactttaccacaaatacagtgtaatatcatcagtnccaaaactgcattacttttgtaaaaacactggttaatttngtataagatattatagagctttttatgctttnanaagttnaaccaatatctttgggggggaactattttnttttntcccntgaaatggggtagctcttacaagtttatggatttgatttttttaaaatcaaagccattgaacacgggnatttngacnganaannttnggctgaaaganttnaccctgcctcactgattgccgttaatgaaaaaatnnaannttacnntgnttttcgaccncntttaaattcggtgagttntttggttncaagaagg

SEQ ID NO: 296 - DNA, 733 bp, Human
agatactatgagaggtcgcatcaccatcaccatcacggatcctatttaggtgacactatagaatcgtcgactctggaccttggctgtcactcagttgacaacaatccagaaatctttgggcctctgaagagaccaatagtggagttctctttagaagatcgaagaaaacttaaaatgaaggaattaagaatccagcgcagcttgcaaaaaatgagatccaagcctgcaactggtgagcctcagaaggggcaaccagagcctgcaaaagaccagcaacagaaggcagctcaacaccacacagaggaacaaagcaaggtgcccccagagcagaagagaaaggcgggctctacctcatggaccgggttccagaccaaggctgaagtggagcaggtggagctgcctgatggaaagaagagaagaaaggtcctggcgctcccctcacaccgaggccccaaaatcaggttgcgggacaaaggcaaagtgaagcccgtccatcccaaaaagccaaagccacagataaaccagtggaagcaggagaagcagcaattatcgtccgagcaggtatctaggaaaaaagctaagggaaataagacggaaacccgcttcaaccagctggtcgaacaatataagcagaaattattgggaccttctaaaggagcacctcttgcaaagaggagcaaatggtttgatagttgatgatggcagcaggctgggtaagaagctgggttgtgta

SEQ ID NO: 297 - DNA, 928 bp, Human
catcaccatcaccatcacggatcctatttaggtgacactatagaatcgtcgacccacgcgtccgtcctcttctccaaggacgaggacatttcgttgactctgaacatgaacgaggaagaagtggagaagcgctttgagggtcggctcaccaagaacatgtcaggatccctctatgagatggtcagccgggtcatgaaagcactggtaaaccgcaagatcacagtgccaggcaacttccaagggcactcaggggcccagtgcattacctgttcctacaaggcaagctcaggactgctctacccgctggagcggggcttcatctacgtccacaagccacctgtgcacatccgcttcgatgagatctcctttgtcaactttgctcgtggtaccactactactcgttcctttgactttgaaattgagaccaagcagggcactcagtataccttcagcagcattgagagggaggagtacgggaaactgtttgattttgtcaacgcgaaaaagctcaacatcaaaaaccgaggattgaaagagggcatgaacccaagctacgatgaatatgctgactctgatgaggaccagcatgatgcctacttggagaggatgaaggaggaaggcaagatccgggaggagaatgccaatgacagcagcgatgactcaggagaagaaaccgatgagtcattcaacccaggtgaagaggaggaagatgtggcagaggagtttgacagcaacgcctctgccagctcctccagtaatgagggtgacagtgaccgggatgagaagaagcggaaacagctcaaaaaggccaagatggccaaggaccgcaagagccgcaagaagcctgtggaggtgaagaaggcaaagaccccaatgcccccaagaggcccatgtctgcatacatgctgtggctcaatgccagccgaga

SEQ ID NO: 298 - DNA, 1179 bp, Human
  misc_feature (824)..(824): n is a, c, g, or t
  misc_feature (936)..(936): n is a, c, g, or t
  misc_feature (940)..(940): n is a, c, g, or t
  misc_feature (949)..(949): n is a, c, g, or t
  misc_feature (952)..(952): n is a, c, g, or t
  misc_feature (990)..(990): n is a, c, g, or t
  misc_feature (992)..(992): n is a, c, g, or t
  misc_feature (1012)..(1012): n is a, c, g, or t
  misc_feature (1026)..(1026): n is a, c, g, or t
  misc_feature (1036)..(1036): n is a, c, g, or t
  misc_feature (1038)..(1038): n is a, c, g, or t
  misc_feature (1061)..(1061): n is a, c, g, or t
  misc_feature (1065)..(1065): n is a, c, g, or t
  misc_feature (1078)..(1078): n is a, c, g, or t
  misc_feature (1101)..(1101): n is a, c, g, or t
  misc_feature (1120)..(1120): n is a, c, g, or t
  misc_feature (1123)..(1123): n is a, c, g, or t
  misc_feature (1132)..(1133): n is a, c, g, or t
  misc_feature (1146)..(1146): n is a, c, g, or t
  misc_feature (1149)..(1149): n is a, c, g, or t
  misc_feature (1153)..(1153): n is a, c, g, or t
  misc_feature (1155)..(1155): n is a, c, g, or t
  misc_feature (1159)..(1160): n is a, c, g, or t
  misc_feature (1172)..(1172): n is a, c, g, or t
  misc_feature (1175)..(1175): n is a, c, g, or t
atagagagaattactatgagaggatcgcatcaccatcaccatcacggatcctatttaggtgacactatagaatcgtcgacccacgcgtccgcgcggatcggggaattctgctggcgctgcagctgcagaatggtcggcggtggcgggaagcgcaggcccggcggagaggggccgcagtgtgaaaaaacaactgatgtgaagaaaagtaaattctgtgaagctgatgtctccagtgaccttcgaaaagaagtagaaaatcattataagctttctttacctgaagatttctatcacttctggaagttctgtgaagaacttgatcctgaaaagccatctgattcactttctgcaagccttggacttcaattagttggtccttatgatatccttgctggaaaacataaaacgaagaaaaaatcaacaggcctgaattttaaccttcactggaggttttactatgatcctcctgagttccagaccattattattggagataataaaactcagtaccacatggggtatttcagggattctcctgatgaatttcctgtatatgttggtataaatgaagcaaagaaaaattgtataattgttccaaatggagataatgtatttgctgcagtcaaattatttttgacgaaaaaacttaaagaaataacggataaaaagaaaatcaatctcttgaaaaacatagatgaaaaactcacagaagcagccagagaattggggtactcgcttgaacagagaaccgtggaagatgaaacagagagataagaaagttgtgacaaagacctttcatggtgcaggcttggttgttccagtanataaaatgatgttgggtaccgagagctccctgaaacagatgctgacctcaagagaatttgcaaagacaatagttgaggctgcaagtgatgaaggagagactaaaaacctttngccnccccattcnggnaaatgaagactttttgggcagtttgctaatggaagaangngattatgggcatggggcctngaattggggaaggnatcccctttngncatggcccccaattatttttcanaaangttgccgggccanccttttaccctcctgcaaaaaanccggtgaaaaaaaaaactnttnccaaaaatnnttgaggaacctcnggnaaancnaaanncaaaaaaaacanaanccac

SEQ ID NO: 299 - DNA, 867 bp, Human
  misc_feature (14)..(14): n is a, c, g, or t
  misc_feature (55)..(56): n is a, c, g, or t
  misc_feature (253)..(254): n is a, c, g, or t
  misc_feature (679)..(679): n is a, c, g, or t
  misc_feature (689)..(689): n is a, c, g, or t
  misc_feature (764)..(764): n is a, c, g, or t
  misc_feature (779)..(779): n is a, c, g, or t
  misc_feature (786)..(786): n is a, c, g, or t
  misc_feature (809)..(809): n is a, c, g, or t
  misc_feature (842)..(843): n is a, c, g, or t
  misc_feature (847)..(847): n is a, c, g, or t
ttattaaagaggantttttacttgagaggatcgcataccatcaccatcacggatnntatttaggtgacactatagaatcgtcgacccacgcgtccgcccacgcgtccgcaaaggtactccagcgtctcattcgctcccgggggaagtcacagatgaagcacctgaccgtacagatgatggcatatgataagctggttcagtgcccaccggagtcatttgatgtgattctggatgagaaccagctggaggatgnntgtgagcacctggctgagtacctggaggtttactggcgggccacgcaccacccagcccctggccccggacttctgggtcctcccagtgccatccccggacttcagaaccagcagctgctgggggagcgtggcgaggagcactccccccttgagcgggacagcttgatgccctctgatgaggccagcgagagctcccgccaagcctggacaggatcttcacagcgtagctcccgccacctggaggaggactatgcagatgcctaccaggacctgtaccagcctcaccgccaacacacctcggggctgcctagtgctaacgggcatgacccccaagaccggcttctagcccaggactcagaacacaaccacagtgaccggaactggcagcgcaaccggcccttggcccaaggatagctactgacagnctcctgctgncctaccctggcaggcacaggcgcagctggctgggggggcccactccaggcagggggggggttagactggcatcangctggcactaggctnagccccnaaaacccctggccaggccccagntttagggctgcctggggtcccaaggttttgggnnaaanaggggacccccctcacctcc

SEQ ID NO: 300 - DNA, 863 bp, Human
  misc_feature (619)..(619): n is a, c, g, or t
  misc_feature (654)..(654): n is a, c, g, or t
acactatgagaggtcgcatcaccatcaccatcacggatcctatttaggtgacactatagaatcgtcgactctggaccttggctgtcactcagttatggtggaggtgaagggcgacctgactgccaagaacatggtgctggctttgctggagctggcgcagcaggaccacggtgctctggactgctgcgtggtggtcattctctctcacggctgtcaggccagccacctgcagttcccaggggctgtctacggcacagatggatgccctgtgtcggtcgagaagattgtgaacatcttcaatgggaccagctgccccagcctgggagggaagcccaagctctttttcatccaggcctgtggtggggagcagaaagaccatgggtttgaggtggcctccacttcccctgaagacgagtcccctggcagtaaccccgagccagatgccaccccgttccaggaaggtttgaggaccttcgaccagctggacgccatatctagtttgcccacacccagtgacatctttgtgtcctactctactttcccaggttttgtttcctggagggaccccaagagtggctcctggtacgttgagaccctggacgacatctttgagcagtgngctcactctgaagacctgcagtccctcctgcttanggtcgctaatgctgtttcggtgaaagggatttataacagatgcctggttgcttaatttcctccggaaaaacttttctttaaacatcataaggcagggccctcaccctgcttatcttgcacccaaactttctgcccaggctgaaaaggctgaagctgatttctgcactcaggatttgcaccggacaggctgctcttcctgcataaacggc

SEQ ID NO: 301 - DNA, 1284 bp, Human
  misc_feature (1)..(1): n is a, c, g, or t
  misc_feature (844)..(844): n is a, c, g, or t
  misc_feature (859)..(859): n is a, c, g, or t
  misc_feature (865)..(865): n is a, c, g, or t
  misc_feature (900)..(900): n is a, c, g, or t
  misc_feature (930)..(930): n is a, c, g, or t
  misc_feature (937)..(937): n is a, c, g, or t
  misc_feature (955)..(955): n is a, c, g, or t
  misc_feature (994)..(994): n is a, c, g, or t
  misc_feature (1004)..(1004): n is a, c, g, or t
  misc_feature (1010)..(1010): n is a, c, g, or t
  misc_feature (1019)..(1019): n is a, c, g, or t
  misc_feature (1023)..(1023): n is a, c, g, or t
  misc_feature (1028)..(1028): n is a, c, g, or t
  misc_feature (1031)..(1031): n is a, c, g, or t
  misc_feature (1049)..(1049): n is a, c, g, or t
  misc_feature (1055)..(1055): n is a, c, g, or t
  misc_feature (1062)..(1062): n is a, c, g, or t
  misc_feature (1066)..(1066): n is a, c, g, or t
  misc_feature (1070)..(1070): n is a, c, g, or t
  misc_feature (1075)..(1076): n is a, c, g, or t
  misc_feature (1085)..(1085): n is a, c, g, or t
  misc_feature (1098)..(1098): n is a, c, g, or t
  misc_feature (1107)..(1107): n is a, c, g, or t
  misc_feature (1114)..(1114): n is a, c, g, or t
  misc_feature (1116)..(1116): n is a, c, g, or t
  misc_feature (1118)..(1118): n is a, c, g, or t
  misc_feature (1121)..(1121): n is a, c, g, or t
  misc_feature (1126)..(1126): n is a, c, g, or t
  misc_feature (1128)..(1128): n is a, c, g, or t
  misc_feature (1147)..(1147): n is a, c, g, or t
  misc_feature (1149)..(1149): n is a, c, g, or t
  misc_feature (1162)..(1162): n is a, c, g, or t
  misc_feature (1176)..(1176): n is a, c, g, or t
  misc_feature (1179)..(1179): n is a, c, g, or t
  misc_feature (1185)..(1185): n is a, c, g, or t
  misc_feature (1190)..(1191): n is a, c, g, or t
  misc_feature (1197)..(1197): n is a, c, g, or t
  misc_feature (1213)..(1213): n is a, c, g, or t
  misc_feature (1225)..(1225): n is a, c, g, or t
  misc_feature (1228)..(1228): n is a, c, g, or t
  misc_feature (1236)..(1236): n is a, c, g, or t
  misc_feature (1238)..(1238): n is a, c, g, or t
  misc_feature (1250)..(1250): n is a, c, g, or t
  misc_feature (1272)..(1272): n is a, c, g, or t
  misc_feature (1275)..(1275): n is a, c, g, or t
  misc_feature (1278)..(1278): n is a, c, g, or t
naattagagaaaattactatgagaggatcgcatcaccatcaccatcacggatcctatttaggtgacactatagaatcgtcgacccacgcgtccgcccacgcgtccgtaaagtttggtgctgaagaactttttaaggaacctgaaggagaagaacaagagccccaggaaatggatatagatgaaatcttgaagagagctgaaactcatgaaaatgaaccaggtcctttaactgtaggagatgaattgctttcccagttcaaggttgccaacttctcaaatatggatgaggatgacattgagttggaacctgaaagaaattcaaagaattgggaggaaattattccagaagatcaaagaagacgattagaagaagaagaaagacaaaaggaacttgaagaaatttatatgctcccaagaatgagaaattgtgcaaaacagattagtttcaatggaagtgaagggaggcgcagtagaagtaggagatactctggatctgatagtgattccatctcagaagggaaaaggccaaagaaacgtggaagaccacggactattcctcgggagaatattaaaggatttagtgatgcagaaattaggcggtttatcaagagctataagaaatttggtggtcctctggaaagattagatgcaattgctcgagatgctgagttagttgataagtcagaaacagaccttagacgactgggagaattggtacataatggttgcattaaagcattaaaggatagttcttcaggaacagaacgaacaggtggtagactcggaaaagtgaagggtccaacattccgaatatcaggagtacaggtgaatgccaaactagtcntctcccatgaagaanaattantacctttgcacaatccattccttctgatccagaanaaagaaagcagtatactatcccatgccacncaaggcngctcattttgatataaanctgggggcaaaaaaaatgatcccattttgttaattggcntcctttgaanatgganatggaaccngggnaaagnatnaaaatggatcctgacccnccgtcntaacccncaanattnttccnnatgatcccnaaaaaaaaacccnagccaaaanggttgcnananccngggcnanctccccctcaaatttcttnantaaaaatcttgcnaaaaaaaaaacccnttnctgggngggannttcaanagggaaaacccaggcntaaaaaaaaaanccntggggccntnaaaggggagggnaaaaaaggggttcccccccccnccnccnaaaacc

SEQ ID NO: 302 - DNA, 1217 bp, Human
  misc_feature (1)..(1): n is a, c, g, or t
  misc_feature (4)..(4): n is a, c, g, or t
  misc_feature (338)..(338): n is a, c, g, or t
  misc_feature (867)..(867): n is a, c, g, or t
  misc_feature (912)..(912): n is a, c, g, or t
  misc_feature (940)..(940): n is a, c, g, or t
  misc_feature (952)..(952): n is a, c, g, or t
  misc_feature (978)..(978): n is a, c, g, or t
  misc_feature (981)..(981): n is a, c, g, or t
  misc_feature (1035)..(1035): n is a, c, g, or t
  misc_feature (1052)..(1052): n is a, c, g, or t
  misc_feature (1070)..(1070): n is a, c, g, or t
  misc_feature (1072)..(1072): n is a, c, g, or t
  misc_feature (1104)..(1104): n is a, c, g, or t
  misc_feature (1108)..(1108): n is a, c, g, or t
  misc_feature (1115)..(1115): n is a, c, g, or t
  misc_feature (1128)..(1129): n is a, c, g, or t
  misc_feature (1137)..(1137): n is a, c, g, or t
  misc_feature (1139)..(1139): n is a, c, g, or t
  misc_feature (1144)..(1144): n is a, c, g, or t
  misc_feature (1150)..(1150): n is a, c, g, or t
  misc_feature (1168)..(1168): n is a, c, g, or t
  misc_feature (1170)..(1170): n is a, c, g, or t
  misc_feature (1173)..(1173): n is a, c, g, or t
  misc_feature (1177)..(1177): n is a, c, g, or t
  misc_feature (1182)..(1182): n is a, c, g, or t
  misc_feature (1184)..(1184): n is a, c, g, or t
  misc_feature (1189)..(1189): n is a, c, g, or t
  misc_feature (1191)..(1191): n is a, c, g, or t
  misc_feature (1195)..(1195): n is a, c, g, or t
  misc_feature (1207)..(1207): n is a, c, g, or t
  misc_feature (1215)..(1215): n is a, c, g, or t
natnagagaaattactatgagaggatcgcatcaccatcaccatcacggatcctatttaggtgacactatagaatcgtcgacccacgcgtccgcccacgcgtccgttcgagagtttgcattcatagacatgccagatgctgcgcatgggatatcttcccaggatggaccattaagtgttttaaagcaagcgaccctgctcctggagaggaatttccatccatttgcggagctgcctgagccacaacagacagctttgagtgacatcttccaggcggtcctatttgatgatgaactactcatggtcctggaaccagtgtgcgatgacctggtcagcggcntctcgcccacagtggcggtgctgggggagctgaagccccggcagcagcaggaccttgtggccttcctgcagctggtggggtgcagcttacagggtgggtgtccgggccccgaggatgcaggcagcaagcagctgtttatgacagcctacttcttggtcagtgccctcgcagaaatgccagatagcgcggcagctctgctgggcacttgctgcaaactccagatcattcccacactgtgccacttgcttcgtgctctgtctgatgatggagtatctgatcttgaagacccaaccttgactcccctgaaagatacagaaaggtttgggattgtgcagcgcttgtttgcctcagctgacattagtctggagagactgaagtcatctgtgaaagctgtcattctgaaggactctaaagtcttcccactgcttctttgtataaccctgaatggactctgtgctttaggcagagaacattcatgatgtcatatgtgaactagaagtacgtgttactggccaaggctatttttcanaactgttaaaggtcatatgcacgtttaaaagttgaccaatgaaantgaatttacagaacagttttaagaaagnggtgacattttngcatgatgaatgaacctgacttttanccnccaggtactctttaaacagtttttccttatcaaaaggcccctcctggtgctggngacccaccatctgaatnaggttccagcatgtaaanantggggagggcggaaaattcttaaacaaaattncaangtttttncggcaaaaaaaannccatctgncncttgnattccntttttgttaaaaaaaagnancgnaccnttaancnaaagncntttnatttggaagggngggaaagnaa

SEQ ID NO: 303 - DNA, 916 bp, Human
gagaggatcgcatcaccatcaccatcacggatcctatttaggtgacactatagaatcgtcgacccacgcgtccggctgtgctgccctggtgaaggctggcaaagtctatgctgcggctaccgaggacatggactgcctcaccttcggcagccctgtgctaatgcgacacctgactgccagtgaagccaaaaagctgccaatccaggaattccacctgagccggattctgcaggagctgggcctgaaccaggaacagtttgtggatctgtgcatcgtgctaggcagtgactactgtgagagtatccggggtattgggcccaagcgggctgtggacctcatccagaagcacaagagcatcgaggagatcgtgcggcgacttgaccccaacaagtaccctgtgccagaaaattggctccacaaggaggctcaccagctcttcttggaacctgaggtgctggacccagagtctgtggagctgaagtggagcgagccaaatgaagaagagctgatcaagttcatgtgtggtgaaaagcagttctctgaggagcgaatccgcagtggggtcaagaggctgagtaagagccgccaaggcagcacccagggccgcctggatgatttcttcaaggtgaccggctcactctcttcagctaagcgcaaggagccagaacccaagggatccactaagaagaaggcaaagactggggcagcagggaagtttaaaaggggaaaataaatgtgtttccccattatacctccttcaccccagaatatttgccgtcttgtacccttaagagctacagctagagaaaccttcacggggtggagagaggattctaaggcttttctagcgtgacccttttcagtagtgctagtcccttttttacttgatcttaatggcaagaaaggccacagaggt

SEQ ID NO: 304 - DNA, 835 bp, Human
  misc_feature (6)..(9): n is a, c, g, or t
  misc_feature (747)..(747): n is a, c, g, or t
  misc_feature (776)..(777): n is a, c, g, or t
  misc_feature (790)..(790): n is a, c, g, or t
  misc_feature (797)..(797): n is a, c, g, or t
atctcnnnncattaagaattactagagaggatgcatcaccatcaccatcacggatcctatttaggtgacactatagaatcgtcgactctggaccttggctgtcactcagttaagcagaaacaatggctaatgactgaggctttagtcaacaatcccaaaattgaagtaatagatgggaagtatgctttcaagcccaagtacaacgtgagagataagaaggccctacttaggctcttagatcagcatgaccagcgaggattaggaggaattcttttagaagacatagaagaagcactgcccaattcccagaaagctgtcaaggctttgggggaccagatactatttgtaaatcgtcccgataagaagaaaatacttttcttcaatgataagagctgtcagttttctgtggatgaagaatttcagaaactgtggaggagtgtcactgtagattccatggacgaggagaaaattgaagaatatctgaagcgacagggtatttcttccatgcaggaatctggaccaaagaaagtggcccctattcagagaaggaaaaagcctgcttcacagaaaaagcgacgctttaagactcataacgaacacttggctggagtgctgaaggattactctgacattacttccagcaaatagggaacagttttgccctggaacagagttacagatacacaatcaagagtgttcttgctgatgctcggggtctgaagactgtcttcctatctgctttctgcngctgaggagaggagcagttcagtttacannaacagtgcaatancaaactncaagcttatttgagtagatgggctcatgggcatgtgat

SEQ ID NO: 305 - DNA, 1290 bp, Human
  misc_feature (1)..(4): n is a, c, g, or t
  misc_feature (1215)..(1217): n is a, c, g, or t
  misc_feature (1244)..(1244): n is a, c, g, or t
  misc_feature (1248)..(1248): n is a, c, g, or t
  misc_feature (1261)..(1262): n is a, c, g, or t
  misc_feature (1274)..(1274): n is a, c, g, or t
  misc_feature (1279)..(1279): n is a, c, g, or t
  misc_feature (1286)..(1287): n is a, c, g, or t
nnnncctgatatactgacttacctataaataggcgtatcacgaggccctttcgtcttccctcgagaaatcataaaaaatttatttgctttgtgagcggataacaattataatagattcaattgtgagcggataacaatttcacacagaattcattaaagaggagaaattaactatgagaggatcgcatcaccatcaccatcacggtcgacccacgcgtccgggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatggcaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaaaccctgttcaccatgggcggcaacgctgaaagacagccctgcaaatttccattccgcttccaggcacattccatgacagctgcaccactgaagggccgcacggagggttacccctgggggggcaccactgagggacacaaccgcaaacaaaaatatggtttctgccctgaaacgccctggcccctgttggggggaactcaaaaggggcccccccggttctccccctccttttccggggaaaaaaaatataaacttccccaaccccgcccccaatgaacgaaaaaaagggggggggcaacccacccaatattaatacgccccccaataccaatgaaaaacccaaaactgaacttggacccccggtaaaaaaaccccaaaaacccccaaaaacccctcggaatttcccaaaaccctcgatctcccccgcgcatatatatcggaaacacccacacctctcccgctaatactnnnacacaaaacctccaacaaaaaaacatntacnaaacccccctcannaatacacaacancacanaacaatnncca

SEQ ID NO: 306 - DNA, 711 bp, Human
  misc_feature (691)..(705): n is a, c, g, or t
  misc_feature (708)..(710): n is a, c, g, or t
agagagaatactatgagaggtcgcatcccatcaccatcacggatcctatttaggtgacactatagaatcgtcgactctggaccttggctgtcactcagttgaacctcttcgaaaaaagaagaaggtagatcctaaaaaagaccaagaagcaaaggagcgcttgaaaaggaagatccgaaaactggaaaaggctactcaagagctaattcctattgaagattttattacccctctaaagttcttggataaagcaagagagcggcctcaggtggagctcacctttgaggagactgagaggagagctctgcttctgaagaagtggtccttgtacaagcagcaagagcgtaagatggagagggacaccatcagggctatgctagaagcccagcaggaagctctggaggaactgcaactggaatccccgaagctccatgctgaggccatcaagcgggatcctaacctgttcccctttgagaaggaagggccacattacacaccaccgatccctaactaccaaccccctgaaggcaggtacaatgacatcaccaaggtgtacacacaagtggagtttaagagatagacttgcaggctgctatccttaacatgctgcccctgagagtaggaatgaaccagggttcagtctgctttccacagaatcaggcatgctgttaataaatactggtttaatccnnnnnnnnnnnnnnngannna

SEQ ID NO: 307 - DNA, 1329 bp, Human
  misc_feature (10)..(10): n is a, c, g, or t
gcctcccctnctaggaaatactatagaggatgcatcaccatcaccatcacggtcgacccacgcgtccggcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtcccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccaaaaccagctgtacagaatctttgatacagacctatttgctaggggtgctgccggggatttggggtcagcatctggccccctatctcctgacccactgagtcatgaggccgggttctctctctccccccctttgtcccccagccagctctaaagcacatgtagccgctgacacctgctggttctgctggcgaaaacctttatccacaccaccaaacaagccaccccacaactccctcacaacacccaccttcccccaccacctcacccccccaaccaacaccaaccacctccacccacacctcctccacatcaaccccaatcattccccacactccagacaacaccacaccactcgccttaaccacctcacatacatcacccccccactaccctcaactcatacacacacacacaaaccacaatccaacccaccactatctatactcatctcatcccatccagaacacacaatttctaccactccccactctcaccctaacaccacaaatagacaattactctcatcaaccttccaacccaccactctaccataccctaaccc

SEQ ID NO: 308 - DNA, 1186 bp, Human
  misc_feature (1)..(1): n is a, c, g, or t
  misc_feature (880)..(880): n is a, c, g, or t
  misc_feature (947)..(947): n is a, c, g, or t
  misc_feature (959)..(959): n is a, c, g, or t
  misc_feature (975)..(975): n is a, c, g, or t
  misc_feature (987)..(987): n is a, c, g, or t
  misc_feature (992)..(992): n is a, c, g, or t
  misc_feature (1023)..(1023): n is a, c, g, or t
  misc_feature (1028)..(1028): n is a, c, g, or t
  misc_feature (1038)..(1038): n is a, c, g, or t
  misc_feature (1045)..(1045): n is a, c, g, or t
  misc_feature (1063)..(1063): n is a, c, g, or t
  misc_feature (1084)..(1084): n is a, c, g, or t
  misc_feature (1088)..(1088): n is a, c, g, or t
  misc_feature (1091)..(1091): n is a, c, g, or t
  misc_feature (1101)..(1101): n is a, c, g, or t
  misc_feature (1106)..(1106): n is a, c, g, or t
  misc_feature (1108)..(1108): n is a, c, g, or t
  misc_feature (1119)..(1119): n is a, c, g, or t
  misc_feature (1132)..(1132): n is a, c, g, or t
  misc_feature (1137)..(1137): n is a, c, g, or t
  misc_feature (1144)..(1145): n is a, c, g, or t
  misc_feature (1148)..(1148): n is a, c, g, or t
  misc_feature (1150)..(1150): n is a, c, g, or t
  misc_feature (1154)..(1154): n is a, c, g, or t
  misc_feature (1156)..(1156): n is a, c, g, or t
  misc_feature (1166)..(1166): n is a, c, g, or t
  misc_feature (1168)..(1168): n is a, c, g, or t
  misc_feature (1179)..(1179): n is a, c, g, or t
  misc_feature (1181)..(1182): n is a, c, g, or t
naatagagaaattactatgagaggatcgcatcaccatcaccatcacggatcctatttaggtgacactatagaatcgtcgacccacgcgtccgagatcccagtggtagctattatggccactggtggtgggatccgggcaatgacttccctgtatgggcagctggctggcctgaaggagctgggcctcttggattgcgtctcctacatcaccggggcctcgggctccacctgggccttggccaacctttatgaggacccagagtggtctcagaaggacctggcagggcccactgagttgctgaagacccaggtgaccaagaacaagctgggtgtgctggcccccagccagctgcagcggtaccggcaggagctggccgagcgtgcccgcttgggctacccaagctgcttcaccaacctgtgggccctcatcaacgaggcgctgctgcatgatgagccccatgatcacaagctctcagatcaacgggaggccctgagtcatggccagaaccctctgcccatctactgtgccctcaacaccaaagggcagagcctgaccacttttgaatttggggagtggtgcgagttctctccctacgaggtcggcttccccaagtacggggccttcatcccctctgagctctttggctccgagttctttatggggcagctgatgaagaggcttcctgagtcccgcatctgcttcttagaaggtatctggagcaacctgtatgcagccaacctccaggacagcttatactgggcctcagagcccagccagttctgggaccgctgggtcaggaaccaggccaacctggacaaggagcaggtcccccttctgaagataaaaaaaccaccctcaacagccggcaggatagctgantttttcaccgatcttctgacgtggcgtccactggcccaggccacacataatttcctgcgtggcctcnatttccacaaanaatactttcagcatcntcacttttccanatggnaagctacactctggatgggctccccaaccanctganaccctcgganccccacntgtgcctgctggaatgtnggctacctcataaaaacaagntgcntgnccttctggancccantngggaagtgganctctatcctgtantggantaaaacnnccngnaacntncaaaaattgnanctctgggccgntnnccaa

SEQ ID NO: 309 - DNA, 1094 bp, Human
  misc_feature (18)..(18): n is a, c, g, or t
  misc_feature (30)..(30): n is a, c, g, or t
  misc_feature (53)..(53): n is a, c, g, or t
  misc_feature (69)..(69): n is a, c, g, or t
  misc_feature (145)..(145): n is a, c, g, or t
  misc_feature (149)..(149): n is a, c, g, or t
  misc_feature (317)..(317): n is a, c, g, or t
  misc_feature (544)..(544): n is a, c, g, or t
  misc_feature (683)..(683): n is a, c, g, or t
  misc_feature (771)..(771): n is a, c, g, or t
  misc_feature (794)..(794): n is a, c, g, or t
  misc_feature (815)..(815): n is a, c, g, or t
  misc_feature (831)..(831): n is a, c, g, or t
  misc_feature (841)..(841): n is a, c, g, or t
  misc_feature (848)..(848): n is a, c, g, or t
  misc_feature (862)..(862): n is a, c, g, or t
  misc_feature (875)..(875): n is a, c, g, or t
  misc_feature (883)..(883): n is a, c, g, or t
  misc_feature (890)..(890): n is a, c, g, or t
  misc_feature (903)..(903): n is a, c, g, or t
  misc_feature (932)..(933): n is a, c, g, or t
  misc_feature (977)..(977): n is a, c, g, or t
  misc_feature (980)..(982): n is a, c, g, or t
  misc_feature (995)..(995): n is a, c, g, or t
  misc_feature (997)..(997): n is a, c, g, or t
  misc_feature (1000)..(1000): n is a, c, g, or t
  misc_feature (1002)..(1002): n is a, c, g, or t
  misc_feature (1011)..(1011): n is a, c, g, or t
  misc_feature (1017)..(1017): n is a, c, g, or t
  misc_feature (1019)..(1019): n is a, c, g, or t
  misc_feature (1031)..(1032): n is a, c, g, or t
  misc_feature (1036)..(1036): n is a, c, g, or t
  misc_feature (1039)..(1039): n is a, c, g, or t
  misc_feature (1042)..(1042): n is a, c, g, or t
  misc_feature (1045)..(1045): n is a, c, g, or t
  misc_feature (1048)..(1048): n is a, c, g, or t
  misc_feature (1050)..(1050): n is a, c, g, or t
  misc_feature (1056)..(1056): n is a, c, g, or t
  misc_feature (1068)..(1068): n is a, c, g, or t
  misc_feature (1073)..(1074): n is a, c, g, or t
  misc_feature (1083)..(1083): n is a, c, g, or t
  misc_feature (1091)..(1091): n is a, c, g, or t
attaaggagagaaataantatgagaggatngcatcaccactcaccatcacggnatcctatttaggtganactatataatcgtcgacccacgcgtccggtgaacgcatcaccattcttcgagggaatcatgagagcagacagatcncacnagtttatggtttctatgatgaatgtttaagaaaatatggaaatgcaaatgtttggaaatattttacagatctttttgactatcttcctctcactgccttggtggatgggcagatcttctgtctacatggtggtctctcgccatctatagatacactggatcatatcanagcacttgatcgcctacaagaagttccccatgagggtccaatgtgtgacttgctgtggtcagatccagatgaccgtggtggttggggtatatctcctcgaggagctggttacacctttgggcaagatatttctgagacatttaatcatgccaatggcctcacgttggtgtctagagctcaccagctagtgatggagggatataactggtgccatgaccggaatgtantaacgattttcagtgctccaaactattgttatcgttgtggtaaccaagctgcaatcatggaacttgacgatactctaaaatactctttcttgcagtttgacccagcacctcgtagaggcgagccacatgttactcgtcntaccccagactacttcctgaaatgaaatttttaaacttgtacagtattgccatgaacccatatatcgaccctaatgggaaatgggaanagcaacagtaaactccaaagtgncaaaaaaatagttaacattcnaaaaactttgttttcncatgggaccnaaaagantgtgcccatataanaattaccaaagcnctctttgncatcaanagcccgtggaccncctttagattggaaccagttccattggcnntgcctgaaaccaacattgtttggttcaaaaaaaccaaggtttcnggnnnaaagcgccaattngnaantnactttttgnttttcncngaaaaaactgcnncaanaanaanaanggnanactttnacccccccgggnaaaannatttaaccntccctttnaac

SEQ ID NO: 310 - DNA, 1614 bp, Human
atggcccgggccgctgccctcctgccgtcgagatcgccgccgacgccgctgctgtggccgctgctgctgctgctgctcctggaaaccggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagagacccccaacacagcaggcgcaggggccacaggcggcatcatcgggggcatcatcgccgccatcattgctactgctgtggctgccacgggcatccttatctgccggcagcagcggaaggagcagacgctgcagggggcagaggaggacgaagacctggagggacctccctcctacaagccaccgaccccaaaagcgaagctggaggcacaggagatgccctcccagctcttcactctgggggcctcggagcacagcccactcaagaccccctactttgatgctggcgcctcatgcactgagcaggaaatgcctcgataccatgagctgcccaccttggaagaacggtcaggacccttgcaccctggagccacaagcctggggtcccccatcccggtgcctccagggccacctgctgtggaagacgtttccctggatctagaggatgaggagggggaggaggaggaagagtatctggacaagatcaaccccatctatgatgctctgtcctatagcagcccctctgattcctaccagggcaaaggctttgtcatgtcccgggccatgtatgtg

SEQ ID NO: 311 - DNA, 833 bp, Human
atgagaggatcgcatcaccatcaccatcacggtcgacccacgcgtccgggcgtctccttgaaggaggctgcaaatgttgtggtcaagtgcctcacccctttctacaaggagggcaagtttgcttccaaggagttgtttaaaggctttgcccgccacctctcacacttgctgactcagaagacctctcctggaaggagcgtgaaagaagaggcccagaacctcatcaggcacttcttccatggccgggcccggtgcgagagcgaagctgactggcatggcctgtgtggcccccagagatgaccaactgctggctgggcagggcccgcgtcctcccccagattctagcatgggtcatcctgggcctcacctgctgatgccagggccatcgtcttttctcagtccttctcctttccaaccatacttggctttggggatgaccccagacaccccctgaatccaggtcagaggtcagcccacctttctttctgcttgcaaagcctatagacccttctcagagcggtcctcatggctgggttttctgggacacatgtcgaggacagaaggtggagggtggtggagctgctgctggaagaaggggaaggaagagtggcccctccccgagttctaagtcaggatgaggcccacctgtccaaggtatcggaacctacccaggggaccctcagatcctccacccactcccccatccattacgatgccagcttccagccttgcccaggtcagagctgtggcagaggagaggcagccaggccctgttcctgctcagctcctgctcaggaaggccaggcctgacagatgtttgggagaggaataaa

SEQ ID NO: 312 - DNA, 1002 bp, Human
  misc_feature (6)..(6): n is a, c, g, or t
  misc_feature (884)..(884): n is a, c, g, or t
  misc_feature (889)..(889): n is a, c, g, or t
  misc_feature (925)..(925): n is a, c, g, or t
  misc_feature (939)..(939): n is a, c, g, or t
  misc_feature (958)..(958): n is a, c, g, or t
  misc_feature (966)..(966): n is a, c, g, or t
  misc_feature (968)..(969): n is a, c, g, or t
  misc_feature (1001)..(1001): n is a, c, g, or t
tagagngaattactatgagaggatcgcatcaccatcaccatcacggatcctatttaggtgacactatagaatcgtcgacccacgcgtccgcattgcttgaacaaaataattgggacttagtggcagctatcaatggtgtaataccacaggaaaatggcattctacaaagtgaatatggaggtgagaccataccaggacctgcatttaatccagcaagtcatccagcttcagctcctacttcctcttcttcttcagcgtttcgacctgtaatgccatccaggcagattgtagaaaggcaacctcggatgctggacttcagggttgaatacagagacagaaatgttgatgtggtacttgaagacacctgtactgttggagagattaaacagattctagaaaatgaacttcagatacctgtgtccaaaatgctgttaaaaggctggaagacgggagatgtggaagacagtacggtcctaaaatctctacacttgccaaaaaacaacagtctttatgtccttacaccagatttgccaccaccttcatcatctagtcatgctggtgccctgcaggagtcattaaatcaaaacttcatgctgatcatcacccaccgagaagtccagcgggagtacaacctgaacttctcaggaagcagtactattcaagaggtaaagagaaatgtgtatgaccttacaagtatccccgttcgccaccaattatgggagggctggccaacttctgctacagacgactcaatgtgtcttgctgaatcagggctctcttatccctgccatcgacttacagtgggaagaagatcttcacctgcacagacccggggaacagtcggaagaaagaaagcttcttgctatctacctccaccatgatgnaaagngtgttaaccaacgggttctgctcacaaatgctttgngctgaatccattgnttcttatctgagtcaaaantttataancnngggcttggggatctgacaaaggactcccacana

SEQ ID NO: 313 - DNA, 1184 bp, Human
  misc_feature (1)..(1): n is a, c, g, or t
  misc_feature (867)..(867): n is a, c, g, or t
  misc_feature (916)..(916): n is a, c, g, or t
  misc_feature (926)..(926): n is a, c, g, or t
  misc_feature (938)..(938): n is a, c, g, or t
  misc_feature (965)..(965): n is a, c, g, or t
  misc_feature (990)..(990): n is a, c, g, or t
  misc_feature (993)..(993): n is a, c, g, or t
  misc_feature (1003)..(1003): n is a, c, g, or t
  misc_feature (1017)..(1017): n is a, c, g, or t
  misc_feature (1022)..(1022): n is a, c, g, or t
  misc_feature (1049)..(1049): n is a, c, g, or t
  misc_feature (1055)..(1055): n is a, c, g, or t
  misc_feature (1058)..(1058): n is a, c, g, or t
  misc_feature (1071)..(1071): n is a, c, g, or t
  misc_feature (1081)..(1081): n is a, c, g, or t
  misc_feature (1085)..(1085): n is a, c, g, or t
  misc_feature (1090)..(1090): n is a, c, g, or t
  misc_feature (1095)..(1095): n is a, c, g, or t
  misc_feature (1099)..(1099): n is a, c, g, or t
  misc_feature (1107)..(1107): n is a, c, g, or t
  misc_feature (1112)..(1112): n is a, c, g, or t
  misc_feature (1120)..(1120): n is a, c, g, or t
  misc_feature (1126)..(1126): n is a, c, g, or t
  misc_feature (1128)..(1128): n is a, c, g, or t
  misc_feature (1133)..(1133): n is a, c, g, or t
  misc_feature (1138)..(1138): n is a, c, g, or t
  misc_feature (1154)..(1154): n is a, c, g, or t
  misc_feature (1158)..(1158): n is a, c, g, or t
  misc_feature (1160)..(1160): n is a, c, g, or t
  misc_feature (1177)..(1178): n is a, c, g, or t
naatagaggaaattacttgagaggatcgcatcaccatcaccatcacggatcctatttaggtgacactatagaatcgtcgacccacgcgtccgattttacttacctcgttagtggttcagaagataagtatgtttatatctggagtacctaccatgacctaagcaagtttacttcagtcaggagagatcgtaatgacttctgggaaggtattaaagcccacaatgcagttgttacatcagccatctttgcaccaaacccaagtttgatgttatctttggatgtgcaatctgaaaaatcagaagggaacgagaaaagtgaagatgctgaagttttggatgccacaccttctggtattatgaagacagataacacagaagttcttctctctgctgacttcactggagcaatcaaagtgtttgttaataaaagaaaaaatgtatcttaatttgaaatggcatttaaaataaacatatcagtaagtttctatatgtatcaaaactgaaaaaatagtgttccaggctaacatacttttttaatttttattgaaagttgttcaaatataatatattttttgagaggcagtgttaatgatctaggaaaccctgggctgatagagtagaaaggaatatggctagaataacattgccaaacattaggctttatgttttgttatgtttgtgttttcgttgtataattatgaacatgcacaagtttctgcatgaaaagatattaatatattaatcacatgtatgtgccttttggttacatgcattaaatctaacagagttaaattatttcagtggctcttttggcctcttactaggggggaatagtcttgtttctagcttaaacaattttttttttgcncaaaatttcatttttaataaaagtggtatcttttgactggagttattgnttttgaaaangggtatataggnttcccggtaggtccaccacccatatgnaaatggtttttaaaaaattccccanttnggggacaaanttttttgggggccnaaatnggggccttaaaaatcctttccttaaangggaanaanaaattttttttcnttgccccccngganccaangtttnttgnaaaaaatntttcnttctttanccggancnccagnctttncccttaaaaaaattancccntnagggggggcctcttttnnaaaagg

SEQ ID NO: 314 - skipped

SEQ ID NO: 315 - DNA, 1218 bp, Homo sapiens
atgagaggatcgcatcaccatcaccatcacggatcctatttaggtgacactatagaatcgtcgacccatgcaagcggtctgcctggtggtcgttgtagcgcaagcattggtcagcctccgctgcctgcaccgctgcctccgagccatggtagcagcagcggtcatccgagcaaaccgtattatgcaccgggtgcaccgacaccgcgtccgctgcatggtaaactggaaagcctgcatggttgtgttcaggcactgctgcgtgaaccggcacagcctggtctgtgggaacagctgggtcagctgtatgaaagcgaacatgatagcgaagaagcaacccgttgttatcatagcgcactgcgttatggtggtagctttgcagaactgggtccgcgtattggtcgtctgcagcaggcccagctgtggaattttcataccggtagctgtcagcatcgtgcaaaagttctgccaccgctggaacaggtttggaatctgctgcatctggaacataaacgtaattatggtgcaaaacgtggtggtccgcctgttaaacgtgcagcagaaccgcctgttgttcagccggttccgcctgcagcactgagcggtccgagcggtgaagagggtctgagtccgggtggtaaacgtcgtcgtggttgtaatagcgaacagacaggtctgcctccgggtctgccgctgccacctcctcctctgcctccaccaccgccaccacctccgcctccaccgcctccgccaccactgccaggtctggcaaccagccctccgtttcagctgaccaaaccgggtctgtggtcaacactgcatggtgatgcatggggtccggaacgtaaaggtagcgcaccgcctgaacgtcaagaacagcgtcatagcctgccgcatccgtatccttatccggcaccggcatataccgcacatccgcctggtcatcgtctggttccggcagcacctcctggtccgggtcctcgtcctccgggtgcagaaagccatggttgtctgcctgcaacccgtccgccaggtagcgatctgcgtgaaagccgtgttcagcgtagccgtatggatagcagcgtttcaccggcagcaaccattgcatgtgttccgtatgcaccgagccgtccgcctggcctgcctggcaccaccaccagtagcagctcaagcagcagcagtaataccggtctgcgtggcgttgaaccgaatccgggtatt

SEQ ID NO: 316 - DNA, 1425 bp, Homo sapiens
attataatagattcaattgtgagcggataacaatttcacacagaaatcattaaagaggagaaattaactatgagaggatcgcatcaccatcaccatcacggatcctatttaggtgacactatagaatcgtcgactctggaccttggctgtcactcagttagacaaggtttctcctatcagggtcgggcttccagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggaccccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcccgggctggcgtctcttgctgtgaactggctgaggaggacttcctggcggtctccccctcggatccacgctaccatgaggtccactacatcctgctggatccttcctgcagtggctcgggtatgccgagcagacagctggaggagcccggggcaggcacacctagcccggtgcgtctgcatgccctggcagggttccagcagcgagccctgtgccacgcgctcactttcccttccctgcagcggctcgtctactccacgtgctccctctgccaggaggagaatgaagacgtggtgcgagatgcgctgcagcagaacccgggcgccttcaggctagctcccgccctgcctgcctggccccaccgaggcctgagcacgttcccgggtgccgagcactgcctccgggcctcccctgagaccacactcagcagtggcttcttcgttgctgtaattgaacgggtcgaggtgccaagctcagcctcacaggccaaagcatcagcaccagaacgcacacccagcccagccccaaagagaaagaagagacagcaaagagccgcagccggtgcttgcacaccgccttgcacatagcagaggctccgggctgactccttcctggtgggaaaggaagatgcctgtcctctccgtggaggaccctgggccctcaccgcaggaagcagtttgggttttgaaaggttattgggtcccttccttgggctgtgttcttgctggtgagcaaagtgttgcctgcaaaaataaaatgcagaacgtactctacgataaaaaaaaaaaaaaaaaaaaaacgagcggccgctccctatagtgagtcgtattaagcttaattagctgagcttggactcctgttgatagatccagtaatgacctcagaactccatctggatttgttcagaacgctcggtg

SEQ ID NO: 317 - skipped

SEQ ID NO: 318 - DNA, 921 bp, Homo sapiens; identical to SEQ ID NO: 19
  misc_feature (2)..(2): n is a, c, g, or t
  misc_feature (713)..(713): n is a, c, g, or t
  misc_feature (718)..(718): n is a, c, g, or t
  misc_feature (752)..(752): n is a, c, g, or t
  misc_feature (764)..(764): n is a, c, g, or t
  misc_feature (769)..(769): n is a, c, g, or t
  misc_feature (776)..(776): n is a, c, g, or t
  misc_feature (779)..(779): n is a, c, g, or t
  misc_feature (789)..(789): n is a, c, g, or t
  misc_feature (802)..(802): n is a, c, g, or t
  misc_feature (806)..(806): n is a, c, g, or t
  misc_feature (814)..(814): n is a, c, g, or t
  misc_feature (821)..(821): n is a, c, g, or t
  misc_feature (825)..(825): n is a, c, g, or t
  misc_feature (828)..(828): n is a, c, g, or t
  misc_feature (831)..(831): n is a, c, g, or t
  misc_feature (835)..(835): n is a, c, g, or t
  misc_feature (838)..(838): n is a, c, g, or t
  misc_feature (842)..(842): n is a, c, g, or t
  misc_feature (847)..(847): n is a, c, g, or t
  misc_feature (858)..(858): n is a, c, g, or t
  misc_feature (860)..(860): n is a, c, g, or t
  misc_feature (865)..(865): n is a, c, g, or t
  misc_feature (878)..(879): n is a, c, g, or t
  misc_feature (884)..(884): n is a, c, g, or t
  misc_feature (886)..(886): n is a, c, g, or t
  misc_feature (897)..(898): n is a, c, g, or t
  misc_feature (907)..(907): n is a, c, g, or t
  misc_feature (910)..(910): n is a, c, g, or t
  misc_feature (917)..(917): n is a, c, g, or t
  misc_feature (919)..(919): n is a, c, g, or t

SEQ ID NO: 319 - DNA, 1138 bp, Homo sapiens; identical to SEQ ID NO: 25
  misc_feature (2)..(2): n is a, c, g, or t
  misc_feature (880)..(880): n is a, c, g, or t
  misc_feature (922)..(922): n is a, c, g, or t
  misc_feature (947)..(947): n is a, c, g, or t
  misc_feature (979)..(979): n is a, c, g, or t
  misc_feature (988)..(988): n is a, c, g, or t
  misc_feature (996)..(996): n is a, c, g, or t
  misc_feature (1023)..(1023): n is a, c, g, or t
  misc_feature (1032)..(1032): n is a, c, g, or t
  misc_feature (1038)..(1038): n is a, c, g, or t
  misc_feature (1041)..(1041): n is a, c, g, or t
  misc_feature (1050)..(1050): n is a, c, g, or t
  misc_feature (1052)..(1054): n is a, c, g, or t
  misc_feature (1059)..(1059): n is a, c, g, or t
  misc_feature (1073)..(1074): n is a, c, g, or t
  misc_feature (1082)..(1082): n is a, c, g, or t
  misc_feature (1084)..(1084): n is a, c, g, or t
  misc_feature (1087)..(1088): n is a, c, g, or t
  misc_feature (1090)..(1090): n is a, c, g, or t
  misc_feature (1093)..(1093): n is a, c, g, or t
  misc_feature (1110)..(1110): n is a, c, g, or t
  misc_feature (1112)..(1112): n is a, c, g, or t
  misc_feature (1115)..(1115): n is a, c, g, or t
  misc_feature (1126)..(1126): n is a, c, g, or t
  misc_feature (1128)..(1128): n is a, c, g, or t

SEQ ID NO: 320 - DNA, 6704 bp, Human
ggcaacatgccagccccgtagcactgcccaccccacccactgtggtctgttgtaccccactgctggggtggtggttccaatgagacagggcacaccaaactccatctggctgttactgaggcggagacacgggtgatgattggctttctggggagagaggaagtcctgtgattggccagatctctggagcttgccgacgcggtgtgaggacgctcccacggaggccggaattggctgtgaaaggactgaggcagccatctgggggtagcgggcactcttatcagagcggctggagccggaccatcgtcccagagagctggggcagggggccgtgcccaatctccagggctcctggggccactgctgacctggctggatgcatcgggcagtggaccctccaggggcccgcgctgcacgggaagcctttgcccttgggggcctgagctgtgctggggcctggagctcctgcccgcctcatccccctcctcgtagcgcatggctgcctggaggcagatgctcagccagcattgggcagcccccgcttcctgctcccctacccccttcacatggcagtagttctgggcaccccagcaaaccatattatgctccaggggcgcccactccaagacccctccatgggaagctggaatccctgcatggctgtgtgcaggcattgctccgggagccagcccagccagggctttgggaacagcttgggcaactgtacgagtcagagcacgatagtgaggaggccacacgctgctaccacagcgcccttcgatacggaggaagcttcgctgagctggggccccgcattggccgactgcagcaggcccagctctggaactttcatactggctcctgccagcaccgagccaaggtcctgcccccactggagcaagtgtggaacttgctacaccttgagcacaaacggaactatggagccaagcggggaggtcccccggtgaagcgagctgctgaacccccagtggtgcagcctgtgcctcctgcagcactctcaggcccctcaggggaggagggcctcagccctggaggcaagcgaaggagaggctgcaactctgaacagactggccttcccccagggctgccactgcctccaccaccattaccaccaccaccaccaccaccaccaccaccaccaccacccctgcctggcctggctaccagccccccatttcagctaaccaagccagggctgtggagtaccctgcatggagatgcctggggcccagagcgcaagggttcagcacccccagagcgccaggagcagcggcactcgctgcctcacccatatccatacccagctccagcgtacaccgcgcacccccctggccaccggctggtcccggctgctcccccaggcccaggcccccgccccccaggagcagagagccatggctgcctgcctgccacccgtccccccggaagtgaccttagagagagcagagttcagaggtcgcggatggactccagcgtttcaccagcagcaaccaccgcctgcgtgccttacgccccttcccggccccctggcctccccggcaccaccaccagcagcagcagtagcagcagcagcaacactggtctccggggcgtggagccgaacccaggcattcccggcgctgaccattaccaaactcccgcgctggaggtctctcaccatggccgcctggggccctcggcacacagcagtcggaaaccgttcttgggggctcccgctgccactccccacctatccctgccacctggaccttcctcaccccctccacccccctgtccccgcctcttacgccccccaccaccccctgcctggttgaagggtccggcctgccgggcagcccgagaggatggagagatcttagaagagctcttctttgggactgagggacccccccgccctgccccaccacccctcccccatcgcgagggcttcttggggcctccggcctcccgcttttctgtgggcactcaggattctcacacccctcccactcccccaaccccaaccaccagcagtagcaacagcaacagtggcagccacagcagcagccctgctgggcctgtgtcctttcccccaccaccctatctggccagaagtatagacccccttccccggcctcccagcccagcacagaacccccaggacccacctcttgtacccctgactcttgccctgcctccagcccctccttcctcctgccaccaaaatacctcaggaagcttcaggcgcccggagagcccccggcccagggtctccttcccaaagacccccgaggtggggccggggccacccccaggccccctgagtaaagccccccagcctgtgccgcccggggttggggagctgcctgcccgaggccctcgactctttgattttccccccactccgctggaggaccagtttgaggagccagccgaattcaagatcctacctgatgggctggccaacatcatgaagatgctggacgaatccattcgcaaggaagaggaacagcaacaacacgaagcaggcgtggccccccaacccccgctgaaggagccctttgcatctctgcagtctcctttccccaccgacacagcccccaccactactgctcctgctgtcgccgtcaccaccaccaccaccaccaccaccaccaccacggccacccaggaagaggagaagaagccaccaccagccctaccaccaccaccgcctctagccaagttccctccaccctctcagccacagccaccaccacccccaccccccagcccggccagcctgctcaaatccttggcctccgtgctggagggacaaaagtactgttatcgggggactggagcagctgtttccacccggcctgggcccttgcccaccactcagtattcccctggccccccatcaggtgctaccgccctgccgcccacctcagcggcccctagcgcccagggctccccacagccctctgcttcctcgtcatctcagttctctacctcaggcgggccctgggcccgggagcgcagggcgggcgaagagccagtcccgggccccatgacccccacccaaccgcccccacccctatctctgccccctgctcgctctgagtctgaggtgctagaagagatcagccgggcttgcgagacccttgtggagcgggtgggccggagtgccactgacccagccgacccagtggacacagcagagccagcggacagtgggactgagcgactgctgccccccgcacaggccaaggaggaggctggcggggtggcggcagtgtcaggcagctgtaagcggcgacagaaggagcatcagaaggagcatcggcggcacaggcgggcctgtaaggacagtgtgggtcgtcggccccgtgagggcagggcaaaggccaaggccaaggtccccaaagaaaagagccgccgggtgctggggaacctggacctgcagagcgaggagatccagggtcgtgagaagtcccggcccgatcttggcggggcctccaaggccaagccacccacagctccagcccctccatcagctcctgcaccttctgcccagcccacacccccgtcagcctctgtccctggaaagaaggctcgggaggaagccccagggccaccgggtgtcagccgggccgacatgctgaagctgcgctcacttagtgaggggccccccaaggagctgaagatccggctcatcaaggtagagagtggtgacaaggagacctttatcgcctctgaggtggaagagcggcggctgcgcatggcagacctcaccatcagccactgtgctgctgacgtcgtgcgcgccagcaggaatgccaaggtgaaagggaagtttcgagagtcctacctttcccctgcccagtctgtgaaaccgaagatcaacactgaggagaagctgccccgggaaaaactcaacccccctacacccagcatctatctggagagcaaacgggatgccttctcacctgtcctgctgcagttctgtacagaccctcgaaatcccatcacagtgatccggggcctggcgggctccctgcggctcaacttgggcctcttctccaccaagaccctggtggaagcgagtggcgaacacaccgtggaagttcgcacccaggtgcagcagccctcagatgagaactgggatctgacaggcactcggcagatctggccttgtgagagctcccgttcccacaccaccattgccaagtacgcacagtaccaggcctcatccttccaggagtctctgcaggaggagaaggagagtgaggatgaggagtcagaggagccagacagcaccactggaacccctcctagcagcgcaccagacccgaagaaccatcacatcatcaagtttggcaccaacatcgacttgtctgatgctaagcggtggaagccccagctgcaggagctgctgaagctgcccgccttcatgcgggtaacatccacgggcaacatgctgagccacgtgggccacaccatcctgggcatgaacacggtgcagctgtacatgaaggtgcccggcagccgaacgccaggccaccaggagaataacaacttctgctccgtcaacatcaacattggcccaggcgactgcgagtggttcgcggtgcacgagcactactgggagaccatcagcgctttctgtgatcggcacggcgtggactacttgacgggttcctggtggccaatcctggatgatctctatgcatccaatattcctgtgtaccgcttcgtgcagcgacccggagacctcgtgtggattaatgcggggactgtgcactgggtgcaggccaccggctggtgcaacaacattgcctggaacgtggggcccctcaccgcctatcagtaccagctggccctggaacgatacgagtggaatgaggtgaagaacgtcaaatccatcgtgcccatgattcacgtgtcatggaacgtggctcgcacggtcaaaatcagcgaccccgacttgttcaagatgatcaagttctgcctgctgcagtccatgaagcactgccaggtgcaacgcgagagcctggtgcgggcagggaagaaaatcgcttaccagggccgtgtcaaggacgagccagcctactactgcaacgagtgcgatgtggaggtgtttaacatcctgttcgtgacaagtgagaatggcagccgcaacacgtacctggtacactgcgagggctgtgcccggcgccgcagcgcaggcctgcagggcgtggtggtgctggagcagtaccgcactgaggagctggctcaggcctacgacgccttcacgctggtgagggcccggcgggcgcgcgggcagcggaggagggcactggggcaggctgcagggacgggcttcgggagcccggccgcgcctttccctgagcccccgccggctttctccccccaggccccagccagcacgtcgcgatgaggccggacgccccgcccgcctgcctgcccgcgcaaggcgccgcggggccaccagcacatgcctgggctggacctaggtcccgcctgtggccgagaagggggtcgggcccagcccttccaccccattggcagctcccctcacttaatttattaagaaaaactttttttttttttttagcaaatatgaggaaaaaaggaaaaaaaatgggagacgggggagggggctggcagcccctcgcccaccagcgcctcccctcaccgactttggcctttttagcaacagacacaaggaccaggctccggcggcggcgggggtcacatacgggttccctcaccctgccagccgcccgcccgcccggcgcagatgcacgcggctcgtgtatgtacatagacgttacggcagccgaggtttttaatgagattctttctatgggctttacccctcccccggaacctccttttttacttccaatgctagctgtgacccctgtacatgtctctttattcacttggttatgatttgtattttttgttcttttcttgtttttttgtttttaatttataacagtcccactcacctctatttattcatttttgggaaaacccgacctcccacacccccaagccatcctgcccgcccctccagggaccgcccgtcgccgggctctccccgcgccccagtgtgtgtccgggcccggcccgaccgtctccacccgtccgcccgcggctccagccgggttctcatggtgctcaaacccgctcccctcccctacgtcctgcactttctcggaccagtccccccactcccgacccgaccccagccccacctgagggtgagcaactcctgtactgtaggggaagaagtgggaactgaaatggtattttgtaaaaaaaataaataaaataaaaaaattaaaggttttaaagaaagaactatgaggaaaaggaaccccgtccttcccagccccggccaactttaaaaaacacagaccttcacccccacccccttttctttttaagtgtgaaacaacccagggccagggcctcactggggcagggacaccccggggtgagtttctctggggctttattttcgttttgttggttgttttttctccacgctggggctgcggaggggtggggggtttacagtcccgcaccctcgcactgcactgtctctctgccccaggggcagaggggtcttcccaaccctacccctattttcggtgatttttgtgtgagaatattaatattaaaaataaacggagaaaaaaaatcct

SEQ ID NO: 321 - DNA, 6433 bp, Human
tgaggagggcccggcctgcgagagcctcagtgggagccggctcagccctcggccaccatgtcggcgccgtcggaggaggaggagtacgcgcggctggtgatggaggcgcagccggagtggctgcgcgccgaggtgaagcggctgtcccacgagctggccgagaccacgcgtgagaagatccaggcggccgagtacgggctggcggtgctcgaggagaagcaccagctcaagctgcagttcgaggagctcgaggtggactatgaggctatccgcagcgagatggagcagctcaaggaggcctttggacaagcacacacaaaccacaagaaggtggctgctgacggagagagccgggaggagagcctgatccaggagtcggcctccaaggagcagtactacgtgcggaaggtgctagagctgcagacggagctgaagcagttgcgcaatgtcctcaccaacacgcagtcggagaatgagcgcctggcctctgtggcccaggagctgaaggagatcaaccagaatgtggagatccagcgtggccgcctgcgggatgacatcaaggagtacaaattccgggaagctcgtctgctgcaggactactcggaactggaggaggagaacatcagcctgcagaagcaagtgtctgtgctcagacagaaccaggtggagtttgagggcctcaagcatgagatcaagcgtctggaggaggagaccgagtacctcaacagccagctggaggatgccatccgcctcaaggagatctcagagcggcagctggaggaggcgctggagaccctgaagacggagcgcgaacagaagaacagcctgcgcaaggagctgtcacactacatgagcatcaatgactccttctacaccagccacctgcatgtctcgctggatggcctcaagttcagtgacgatgctgccgagcccaacaacgatgccgaggccctggtcaatggctttgagcacggcggcctggccaagctgccactggacaacaagacctccacgcccaagaaggagggcctcgcaccgccctcccccagcctcgtctccgacctactcagtgagctcaacatctctgagatccagaagctgaagcagcagctgatgcagatggagcgggaaaaggcgggcctgctggcaacgctgcaggacacacagaagcagctggagcacacgcggggctccctgtcagaacagcaggagaaggtgacccgcctcacagagaatctgagtgccctgcggcgcctgcaggccagcaaggagcggcagacagccctggacaacgagaaggaccgtgacagccatgaggatggggactactacgaggtggacatcaacgggcctgagatcttggcctgcaagtaccatgtggctgtggctgaggctggcgagctccgcgagcagctcaaggcactgcgcagcacgcacgaggctcgtgaggcccagcacgccgaggagaagggccgctatgaggctgagggccaggcactcacggagaaggtctccctgctagagaaggccagccgccaggaccgcgagctgctggcccggctggagaaggagctaaagaaggtgagcgacgtcgccggcgagacacagggcagcctgagtgtggcccaggatgagctggtgaccttcagtgaggagctggccaatctctaccaccacgtgtgcatgtgcaacaatgagacacccaaccgtgtcatgctggactactaccgcgagggccagggcggggccggccgcaccagtcccgggggccgcaccagccccgaggcgcgtggccggcgctcacccatcctcctacccaaggggctgctggctcctgaggcgggccgagcagatggtgggacgggggacagcagcccctcgcctggctcctcactgccatcacccctgagtgacccacgccgggagcccatgaacatctacaacctgatcgctatcatccgtgaccagatcaagcacctgcaggcagccgtggaccgcaccacggagctgtcacgccagcgcattgcctctcaggagctgggccccgccgtggacaaggacaaggaagcgcttatggaggagatcctcaagctgaagtcgctgctcagcaccaagcgggagcagatcaccacgctgcgcactgtgctcaaggccaacaagcagacggccgaggtggcccttgccaacctgaagagcaagtatgagaatgagaaggccatggttaccgagaccatgatgaagctgcgcaatgagctcaaggccctcaaggaggacgcagccaccttctcctcgctgcgtgctatgtttgccaccaggtgtgacgagtacattacacagctggatgagatgcagcggcagctggcggctgctgaggacgagaagaagacgctgaactcgctgctgcgcatggccatccagcagaagctggcgctgacccagcggctggagctgctcgagctggaccatgagcagacccggcgtggccgtgccaaagccgccccgaagaccaagccagccacaccgagcgtaagtcacacctgtgcctgtgccagcgacagggccgagggcaccgggctggccaaccaggtgttctgcagcgagaagcacagcatttactgtgattaggggctgtggggcgccgcacgctgcagctaacatctgcttcacctcaactaacccagcagcagcgggacggcggtgctaggtcaatcttaacgtgactaatgcacagagggtaggagtctagccgaggcgccatggggcgttgcatcagcaggacacttgtgagagctttgtgtcgcttctcactcctcaaagccccctcaggagcacccagtcctcagctgctctcttaggtgggggtcagaggtggggatagagctgcacattcttgcagcagatgtgtgatgaaagcatcttctaagccctgcgcacccgtggggaaacccaagggaggagtcctggtcctgctccctcagcacccaaaaggggcagaacctgagttgagacttgcatgttcctcgcatgtgtctaatgtcagcactagaaagcagttttaggaggttccagcctgcagcataggtacgacctcagaggatggctttgcacttggcatagtttcatggaaaggagtacgttgtagtttatgcagtatctgactgcaaatcatattcaggaaagaagtgcagaatttcttccccaagcccagagaagagcagccctgagcccctgtattctgctggccagacacacatggcacagacacagctgaccataacccaggaatccagagctcggtttctcatttctgagatcaggatgcttgtatagtggcctgtgaggtgacagattggcagggcccaaggccccaggttttcatttttcatgagaaaagctttccaagtgcctggccagaccttggtccttagtgcagagcccgtccttttgtacttggggtgaccccagcagccaattatccggccttccatagggggttcagtcccaaagacatggggctttgaaaaccctagcctgaagtctgagccaccaagggcttggctgggttggacacccacaggtgtatccagagcccagcccggtgctgggaaagctttgcatagggccagggccacttgtcaggattcacaggtaggagatgtttaggtctctttatttagtgcaatctgggggatggcaacagagaaagaggaaaggtagctgtagggttctcccatttccagaggctccatccacacctgccttcccacattctgagcagaacttttctcagtacttttttcccgatcaccctgtgggaccagctggacctgaggctgcagtcttctctcctgcaggctgcttgccttgtctctcatgcggaagaggcattcgagttacctggtgagagaccgtgttgccccctcccacagctctctgccctgcgcgttcttccctttggtgccgagtatgtttcggtcccctccagactccaggacacgcccatgtatgtcccctgcgtgttcatcctgggcccagatccccctgccccagcaagactcgcagtgggatggctgctggcatgcccaccctgcatgcgctttgccctctccttgcaagcctggcacatagcttctctccatactcctaagggactttgcagacacccaagccactgggacccctgctaacacatgcaggtcttctcttctgccaactaacgtgctcgcgccctcccagcacgtggagagcttcaattgtcagataaacaggaagcgacagatgaccgctttctaacgctctcttttctcccgttttcagctgtagagtagctgccaggaggacttggccacccggccctgtcacactgcagccccttccccttccctctcgtggcccacaaggaggaaggaagggcaacctaaaagcccacttagaaactttttggatatgccactgcaattcttttcaaaatagcattccccaggtttttaatgggaggaaaaaaagctttaatgttgagcatgctgcgagctgctgcgtggaaaggcctctgtatgggccgaagacccttcttccctggctgccaggctcgccaggagcccactggaaacgcccaccacgggggctccttgttacacatgttctttttttatccgatcaacctgtgcacttttgatattttgatattatatttgcttccttaattcctcgcgtagagacggtctcaggtgccgtggtctatgctcgtggtcctgtagctgtccgcctcagctcccaccgtgtttgtctggtgtcagcacgaggcagagctgtgtgctccatagcgtgtagctttagactcggagatgagtgctttgacccagcgaggagctcagctaagtgtatccacgctgtggttcagcagcctttagatcatacggcattgtggttcatgtttgaaattacagattttaaatgccatgttcattaagaaatccagggtattcagattctggggtttttcatattgtattattattattcttaggaatagttcaatgtaacaagaagaaaacttgacctttgctctggttaaaacagtaataggcacttgaaaaaaaaagataaattattgaatgagtagtattacctacaaattccagaattttctgggttttaggacgttgtgaagcatgactgattaacagaattttatacaactgtaccaataaaattccaaattggaattgttttgttactctggttgttgtgccaaattgtggtacacttagaaaattctacagtcgtcgatttttagggtgttctctttcaacacctttttgttagtaatcattgccagtagtgccttcatcagttaagggaggtgtcccagcacagatcattctcaaaagcgagcagggaagagctagtgggcatgctgaaggccagcgtggacagcaggtgaggcaggtgctcctcacacccagacctgggcatcttcattgagggaaagaaaacagtcattgtgcaaaattctgttagtcagtgattctttacttgcaaattcaggggcttagaaaatgaaagcaaacacaaaaccttgagtgtgctttgggaaccaaatggaccttctgggacaagctgagcaagctgtatgaacgccacgtttgtgaagagctgagggtatcaggagggccgacgctgtgttggcatgcgcagtaggggatgagggttagccatagtattctttgcaaatgtgaaagcgagacattatatcttctcttgcttggtgtaactaatcactgttaatttcaggaaacagaactcattaaaactccttagcaaaccaggtctacatcctgttttgtttgctgagtgaggttagtgggagtggtcaaattggtactcttggaggaagaaaaactgtccttccttctccaaaaaaggaaaaattataataatataaatgacaaaaataaaagaattctgtttcctggaataagcatttcttattcctagttgtagggactcctatttttaccttccgttacagtgttgattcataagaaatattgttacatttgagataacttcatctgtatggggtatttatttgcaatgatgtctgagtactgtattttttctgtgcattaccttagtgtcagaatgttggtctttattttaaagtcatatgcatgttctcctgccaaggaacctttacacagacccaaacaaaaaaataataatcaaatgccttcaatttctgagaaaatgaggcagagcatggaaaaggaataggaaggagaaattaattgagattttcaggacacagacatatgatgtgaatgcctacaaagccagtgcgcataggaacagtgggcctgggtaaagagtcacattggtaggaccaataaagaataataaaaagacaaagcacaaaaaaaaaaaaaaaaaa

SEQ ID NO: 322 - DNA, 2372 bp, Human
gctttttgaccccggaagtccgggcgggcgccgagccgggtgcgttttgccacagagccgtaaaggcgcgcgggaacatggggctgtatgctgcagctgcaggcgtgttggccggcgtggagagccgccagggctctatcaaggggttggtgtactccagcaacttccagaacgtgaagcagctgtacgcgctggtgtgcgaaacgcagcgctactccgccgtgctggatgctgtgatcgccagcgccggcctcctccgtgcggagaagaagctgcggccgcacctggccaaggtgctagtgtatgagttgttgttgggaaagggctttcgagggggtgggggccgatggaaggctctgttgggccggcaccaggcgaggctcaaggctgagttggctcggctcaaggttcatcggggtgtgagccggaatgaggacctgttggaagtgggatccaggcctggtccagcctcccagctgcctcgatttgtgcgtgtgaacactctcaagacctgctccgatgatgtagttgattatttcaagagacaaggtttctcctatcagggtcgggcttccagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggaccccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcccgggctggcgtctcttgctgtgaactggctgaggaggacttcctggcggtctccccctcggatccacgctaccatgaggtccactacatcctgctggatccttcctgcagtggctcgggtatgccgagcagacagctggaggagcccggggcaggcacacctagcccggtgcgtctgcatgccctggcagggttccagcagcgagccctgtgccacgcactcactttcccttccctgcagcggctcgtctactccacgtgctccctctgccaggaggagaatgaagacgtggtgcgagatgcgctgcagcagaacccgggcgccttcaggctagctcccgccctgcctgcctggccccaccgaggcctgagcacgttcccgggtgccgagcactgcctccgggcctcccctgagaccacactcagcagtggcttcttcgttgctgtaattgaacgggtcgaggtgccaagcctcacaggccaaagcatcagcaccagaacgcacacccagcccagccccaaagagaaagaagagacagcaaagagccgcagccggtgcttgcacaccgccttgcacatagcagaggctccgggctgactccttcctggtgggaaaggaagatgcctgtcctctccgtggaggaccctgggccctcaccgcaggaagcagtttgggttttgaaaggttattgggtcccttccttgggctgtgttcttgctggtgagcaaagtgttgcctgcaaaaataaaatgcagaacgtactctacgatagatcacagttttttattcttaatgtcacaagcaggagaaaaatctcacattcatactaaaagttccaactagactcaacaggaatgaagtctctatttgtaatggaaagtcccagcctcccgctgccgtccagtgcgtgtactgtacacatccacactcacactcactcagggttcccggaccggctgtcctgcctgcggaactgaggtaaactagctcaggtgctgacactaggagggtctaccttacataaggtacaggtagaagcttgattgctaggcccaggcccacccagaccctccaatcctaacaggtatttaggcttgaggttcactccctcctcagctgcacacgcagccaggtattaacgaggatcagagctgttctgaggggtgggaaggagcagccccaccaccactcactcaccctcagtcacatcggggagggggcaccagttacatttacatcacattatttataaaataagaattacatttcatataacatggccagaaggagctctagtcccccaggaaagctgccggggacagcatttgagcctcttctttgcacaggcataacttaactatacagctaattcctagttaatagcatttatacttaaccacctcaatgaaccaagcttgaaggaatttaaaaggcaatttagcttaaatacaaaaataaatttttgttaaaaaacgttta

SEQ ID NO: 323 - DNA, 4970 bp, Human
agtcagccctgctgccagccagtgccgggtgctggggactcagggaggcccgccgggaccactgcgggacagtgagccgagcagaagctggaacgcaggagaggaaggagagggggcggtcagggctctcaggagccgggtcctgggcaaggcgcagccgttttcaaattttcaggaaagcggtcggctcacactcgagcagtaaaaagatgcctctggggaggaggcccgtgcagctctccgggcaatggtggtggctcggcctagagaggcggtagtggaacgcagaccctggtgggggaatgacatcaagggaggagacgggcgggaccccagatttctgcctgtgggcgatggaagtgaggttcactggccagcggagccggacacagaacgcgcaaaacgccgtgtaggcctggaggagccgaagagcaggcggaccccctccgcgggggaacagtttccgccgggagcacaaagcaacggaccggaagtggggggcggaagtgcagtgggctcagcgccgactgcgcgcctctgcccgcgaaaactctgagctggctgacagctggggacgggtggcggccctcgactggagtcggttgagttcctgagggaccccggttctggaaggttcgccgcggagacaagtgagcagtctgtgccatagggattctcgaagagaacagcgttgtgtcccagtgcacatgctcgcatcgcttaccaggagtgcccgagaccctaagatgttcggagtggttttttcgcacagacccgaatagcctgcccctcagccacgctctgtgcccttctgagaacaggctgatatgcccaagatagtcctgaatggtgtgaccgtagacttccctttccagccctacaaatgccaacaggagtacatgaccaaggtcctggaatgtctgcagcagaaggtgaatggcatcctggagagccctacgggtacagggaagacgctgtgcctgctgtgcaccacgctggcctggcgagaacacctccgagacggcatctctgcccgcaagattgccgagagggcgcaaggagagcttttcccggatcgggccttgtcatcctggggcaacgctgctgctgctgctggagaccccatagcttgctacacggacatcccaaagattatttacgcctccaggacccactcgcaactcacacaggtcatcaacgagcttcggaacacctcctaccggcctaaggtgtgtgtgctgggctcccgggagcagctgtgcatccatcctgaggtgaagaaacaagagagtaaccatctacagatccacttgtgccgtaagaaggtggcaagtcgctcctgtcatttctacaacaacgtagaagaaaaaagcctggagcaggagctggccagccccatcctggacattgaggacttggtcaagagcggaagcaagcacagggtgtgcccttactacctgtcccggaacctgaagcagcaagccgacatcatattcatgccgtacaattacttgttggatgccaagagccgcagagcacacaacattgacctgaaggggacagtcgtgatctttgacgaagctcacaacgtggagaagatgtgtgaagaatcggcatcctttgacctgactccccatgacctggcttcaggactggacgtcatagaccaggtgctggaggagcagaccaaggcagcgcagcagggtgagccccacccggagttcagcgcggactcccccagcccagggctgaacatggagctggaagacattgcaaagctgaagatgatcctgctgcgcctggagggggccatcgatgctgttgagctgcctggagacgacagcggtgtcaccaagccagggagctacatctttgagctgtttgctgaagcccagatcacgtttcagaccaagggctgcatcctggactcgctggaccagatcatccagcacctggcaggacgtgctggagtgttcaccaacacggccggactgcagaagctggcggacattatccagattgtgttcagtgtggacccctccgagggcagccctggttccccagcagggctgggggccttacagtcctataaggtgcacatccatcctgatgctggtcaccggaggacggctcagcggtctgatgcctggagcaccactgcagccagaaagcgagggaaggtgctgagctactggtgcttcagtcccggccacagcatgcacgagctggtccgccagggcgtccgctccctcatccttaccagcggcacgctggccccggtgtcctcctttgctctggagatgcagatccctttcccagtctgcctggagaacccacacatcatcgacaagcaccagatctgggtgggggtcgtccccagaggccccgatggagcccagttgagctccgcgtttgacagacggttttccgaggagtgcttatcctccctggggaaggctctgggcaacatcgcccgcgtggtgccctatgggctcctgatcttcttcccttcctatcctgtcatggagaagagcctggagttctggcgggcccgcgacttggccaggaagatggaggcgctgaagccgctgtttgtggagcccaggagcaaaggcagcttctccgagaccatcagtgcttactatgcaagggttgccgcccctgggtccaccggcgccaccttcctggcggtctgccggggcaaggccagcgaggggctggacttctcagacacgaatggccgtggtgtgattgtcacgggcctcccgtaccccccacgcatggacccccgggttgtcctcaagatgcagttcctggatgagatgaagggccagggtggggctgggggccagttcctctctgggcaggagtggtaccggcagcaggcgtccagggctgtgaaccaggccatcgggcgagtgatccggcaccgccaggactacggagctgtcttcctctgtgaccacaggttcgcctttgccgacgcaagagcccaactgccctcctgggtgcgtccccacgtcagggtgtatgacaactttggccatgtcatccgagacgtggcccagttcttccgtgttgccgagcgaactatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggcccacagctgctccaccctgtccctcctgtctgagaagaggccggcagaagaaccgcgaggagggaggaagaagatccggctggtcagccacccggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggcttctaccagtttgtgcggccccaccataagcagcagtttgaggaggtctgtatccagctgacaggacgaggctgtggctatcggcctgagcacagcattccccgaaggcagcgggcacagccggtcctggaccccactggaagaacggcgccggatcccaagctgaccgtgtccacggctgcagcccagcagctggacccccaagagcacctgaaccagggcaggccccacctgtcgcccaggccacccccaacaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacaggttcagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggcctctaggatgtgcccagcctgccacaccgcctccaggaagcagagcgtcatgcaggtcttctggccagagccccagtgagtgcccacggaggcccccagcacacccaacgtggcttgatcacctgcctgtccagctctggtgggccaagaacccacccaacagaataggccagcccatgccagccggcttggcccgctgcaggcctcaggcaggcggggcccatggttggtccctgcggtgggaccggatctgggcctgcctctgagaagccctgagctaccttggggtctggggtgggtttctgggaaagtgcttccccagaacttccctggctcctggcctgtgagtggtgccacaggggcaccccagctgagcccctcaccgggaaggaggagacccccgtgggcacgtgtccacttttaatcaggggacagggctctctaataaagctgctggcagtgcccaggacggtgaaaaaaaaaaaaaaa

SEQ ID NO: 324 - DNA, 3574 bp, Human
gtcaggtgacgcgagacccagccggaagtgaaggaaaaagcgcttcagcccgcggcgcctgcgcagaacgctccagacgctgagaggcaggaggcactagggatcgtccgcaggattgggactgatacagaggccgccacggagcccgccggagccaccgttcctgctgctgccgccgctgcccgaatcggaaccgtcgggccgcagccgccggcaatgccgcgaaggaagaggaatgcaggcagtagttcagatggaaccgaagattccgatttttctacagatctcgagcacacagacagttcagaaagtgatggcacatcccgacgatctgctcgagtcacccgctcctcagccaggctaagccagagttctcaagattccagtcctgttcgaaatctgcagtcttttggcactgaggagcctgcttactctaccagaagagtgacccgtagtcagcagcagcctaccccagtgacaccgaaaaaataccctcttcggcagactcgttcatctggttcagaaactgagcaagtggttgatttttcagatagagaaactaaaaatacagctgatcatgatgagtcaccgcctcgaactccaactggaaatgcgccttcttctgagtctgacatagacatctccagccccaatgtatctcacgatgagagcattgccaaggacatgtccctgaaggactcaggcagtgatctctctcatcgccccaagcgccgtcgcttccatgaaagctacaacttcaatatgaagtgtcctacaccaggctgtaactctctaggacaccttacaggaaaacatgagagacatttctccatctcaggatgcccactgtatcataacctctcagctgacgaatgcaaggcaccaacggagaggcagcttcgatataaggaaaaagtggctgaactcaggaagaaaagaaattctggactgagcaaagaacagaaagagaaatatatggaacacagacagacctatgggaacacacgggaacctcttttagaaaacctgacaagcgagtatgacttggatcttttccgaagagcacaagcccgggcttcagaggatttggagaagttaaggctgcaaggccaaatcacagagggaagcaacatgattaaaacaattgcttttggccgctatgagcttgatacctggtatcattctccatatcctgaagaatatgcacggctgggacgtctctatatgtgtgaattctgtttaaaatatatgaagagccaaacgatactccgccggcacatggccaaatgtgtgtggaaacacccacctggtgatgagatatatcgcaaaggttcaatctctgtgtttgaagtggatggcaagaaaaacaagatctactgccaaaacctgtgcctgttggccaaactttttctggaccacaagacattatattatgatgtggagcccttcctgttctatgttatgacagaggcggacaacactggctgtcacctgattggatatttttctaaggaaaagaattcattcctcaactacaacgtctcctgtatccttactatgcctcagtacatgagacagggctatggcaagatgcttattgatttcagttatttgctttccaaagtcgaagaaaaagttggctccccagaacgtccactctcagatctggggcttataagctatcgcagttactggaaagaagtacttctccgctacctgcataattttcaaggcaaagagatttctatcaaagaaatcagtcaggagacggctgtgaatcctgtggacattgtcagcactctgcaagcccttcagatgctcaaatactggaagggaaaacacctagttttaaagagacaggacctgattgatgagtggatagccaaagaggccaaaaggtccaactccaataaaaccatggatcccagctgcttaaaatggacccctcccaagggcacttaaagtgacctgtcattccgagccagcgaaccccagcagtaggaatccgtaccctagggatctgtctgtcatttctctgttgctcttgtgattggcaagtacagtatcctttgggaaggccatccccctcaggactgtcctggctccgacctttgtgtacactgcagacgctggttctgaggaactgttgtttcggcctcagtgaggttgcctggatgggatctgtattagacttgagtgcaggtctctcagcactgacccaaggagttctgttatggtactgtacctgtccagtcactggttctctcctcatgtcctctcgccccatgaggttgtgttgtgtcttctaagcgtggtactagtgcttgccacctggtcaccagacctccaaatatggctgccaccaccaggacctttccagttactccttatatgtgtgttctatggaggggcagggaaaaggtggcacttgtgagtgtgtgtggattggcagggggtccattcactttgggttccatcttgctttaaatttcttcattttgattaagagacctctttttgatctgtattgggctaaccagagccaaatacttttgaagagtttcccagggactagtcatggtaatagcatataattgatctgaatgagatggagagaagaatgaaggggtggtggttctgggtttgatttgagttcacctgtgggcagtgggcagtgggcagtgtcttggtgaaagggaacggatactactttttgcctcaccgtaaagtactcactagtaaatatttccttctctctttactcccactttttacgtttgcaggtgccaaagtaatgtccacttttccctttcatgctgcatattaactggttaattatactgcagaaaccttttcacctccactagtctgatacagtacatctgtacttccatataccttgcactgattttgtctgagtgccctgggagaagtagaaaatgattgaaagtgacttccgtatctcagcccatgactcagcaaggcagaatggccacccctgccaaagtttgcttctcttttcaacagtgcctcaccctccctctaggattaaagtgcttctgcccttccacgaactcctcctccatttcctttttgggatttgtcaccatccttctattctctggtcttctatttttggtgttgttcaagtgaaggaagagatgttccctctaatttctctctagcccattataacctgctatcttggggcaacttttgatgtatgacatgtcacccttcccaacttggtctcctccaacatgctgtcttcatgtggagccctcaccacaatccctgactccggtcatttgtgcctttctcttgtcatctctgtacactacttatattcactgtgggttgggggagctaattttaagcatgttcagtggcagctcccctccagtttcagtgtcactgttaaaatttatcaaaaagcaacttcactaggggttttcttaagggataaaggccttttacagaagctaaacccttccccacatgtggtagaatgtgctcttctatatctactcctcaataaagcatgttctctgctcaaaaaaaaaaaaaaaaaaaa

SEQ ID NO: 325 - DNA, 2132 bp, Human
aatggggcgccgactcggcgcaggaacaaggcgggggttcggggccggctgcagactctcaccgcagcggccaggaacgccagccgttcacgcgttcggtcctccttggctgactcaccgccctggccgccgcaccatggacgcccccaggcaggtggtcaactttgggcctggtcccgccaagctgccgcactcagtgttgttagagatacaaaaggaattattagactacaaaggagttggcattagtgttcttgaaatgagtcacaggtcatcagattttgccaagattattaacaatacagagaatcttgtgcgggaattgctagctgttccagacaactataaggtgatttttctgcaaggaggtgggtgcggccagttcagtgctgtccccttaaacctcattggcttgaaagcaggaaggtgtgctgactatgtggtgacaggagcttggtcagctaaggccgcagaagaagccaagaagtttgggactataaatatcgttcaccctaaacttgggagttatacaaaaattccagatccaagcacctggaacctcaacccagatgcctcctacgtgtattattgcgcaaatgagacggtgcatggtgtggagtttgactttatacccgatgtcaagggagcagtactggtttgtgacatgtcctcaaacttcctgtccaagccagtggatgtttccaagtttggtgtgatttttgctggtgcccagaagaatgttggctctgctggggtcaccgtggtgattgtccgtgatgacctgctggggtttgccctccgagagtgcccctcggtcctggaatacaaggtgcaggctggaaacagctccttgtacaacacgcctccatgtttcagcatctacgtcatgggcttggttctggagtggattaaaaacaatggaggtgccgcggccatggagaagcttagctccatcaaatctcaaacaatttatgagattattgataattctcaaggattctacgtgtctgtgggaggcatccgggcctctctgtataatgctgtcacaattgaagacgttcagaagctggccgccttcatgaaaaaatttttggagatgcatcagctatgaacacatcctaaccaggatatactctgttcttgaacaacatacaaagtttaaagtaacttggggatggctacaaaaagttaacacagtatttttctcaaatgaacatgtttattgcagattcttcttttttgaaagaacaacagcaaaacatccacaactctgtaaagctggtgggacctaatgtcaccttaattctgacttgaactggaagcattttaagaaatcttgttgcttttctaacaaattcccgcgtattttgcctttgctgctactttttctagttagatttcaaacttgcctgtggacttaataatgcaagttgcgattaattatttctggagtcatgggaacacacagcacagagggtaggggggccctctaggtgctgaatctacacatctgtggggtctcctgggttcagcggctgttgattcaaggtcaacattgaccattggaggagtggtttaagagtgccaggcgaagggcaaactgtagatcgatctttatgctgttattacaggagaagtgacatactttatatatgtttatattagcaaggtctgtttttaataccatatactttatatttctatacatttatatttctaataatacagttatcactgatatatgtagacacttttagaatttattaaatccttgaccttgtgcattatagcattccattagcaagagttgtaccccctccccagtcttcgccttcctctttttaagctgttttatgaaaaagacctagaagttcttgattcatttttaccattctttccataggtagaagagaaagttgattggttggttgtttttcaattatgccattaaactaaacatttctgttaaattaccctatcctttgttctctactgttttctttgtaatgtatgactacgagagtgatactttgctgaaaagtctttcccctattgtttatctattgtcagtattttatgttgaatatgtaaagaacattaaagtcctaaaacatctaaaaaaaaaaaaaaaa

SEQ ID NO: 326 - DNA, 1455 bp, Human
atgtcccgccgcgagagggggcggagcgagcgtgcgcggcgggcgcgcgcaggctccgtaaccgaaccctgagccgcctgcgcggatcggcgtccgcagcgggcggctgctgaggggaaattcacgttacctctccacgtgccgaccaaggctctgagacccccagctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtgccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccaccattctgtccatctggctggctacccgccgtgtccatcctgccttggacacctacatcaaggagcggaagctgtgtgcctatcctcggctggagatctaccaggaagaccagatccatttcatgtgcccactggcacggcagggagacttctatgtgcctgagatgaaggagacagagtggaaatggcgggggcttgtggaggccattgacacccaggtggatggcacaggagctgacacaatgagtgacacgagttctgtaagcttggaagtgagccctggcagccgggagacttcagctgccacactgtcacctggggcgagcagccgtggctgggatgacggtgacacccgcagcgagcacagctacagcgagtcaggtgccagcggctcctcttttgaggagctggacttggagggcgaggggcccttaggggagtcacggctggaccctgggactgagcccctggggactaccaagtggctctgggagcccactgcccctgagaagggcaaggagtaacccatggcctgcaccctcctgcagtgcagttgctgaggaactgagcagactctccagcagactctccagccctcttcctccttcctctgggggaggaggggttcctgagggacctgacttcccctgctccaggcctcttgctaagccttctcctcactgccctttaggctcccagggccagaggagccagggactattttctgcaccagcccccagggctgccacccctgttgtgtctttttttcagactcacagtggagcttccaggacccagaataaagccaatgatttacttgtttcacctggaaaaaaa

SEQ ID NO: 327 - DNA, 1946 bp, Human
gcttctgagcggaaactgaaagtgaaatagggagctggctaccagcgttgagtcccctgtaaagccaaaccccctaaaggtctccacactgctgtttaacggcacacttgacaatggcttcagcagcacgcttgacaatgatgtgggaggaggtcacatgccctatctgcctggaccccttcgtggagcctgtgagcatcgagtgtggccacagcttctgccaggaatgcatctctcaggttgggaaaggtgggggcagcgtctgtcctgtgtgccggcagcgctttctgctcaagaatctccggcccaatcgacagctagccaacatggtgaacaaccttaaagaaatcagccaggaggccagagagggcacacagggggaacggtgtgcagtgcatggagagagacttcacctgttctgtgagaaagatgggaaggccctttgctgggtatgtgcccagtctcggaaacaccgtgaccacgccatggtccctcttgaggaggctgcacaggagtaccaggagaagctccaggtggcattaggggaactgagaagaaagcaggagttggctgagaagttggaagtggaaattgcaataaagagagcagactggaagaaaacagtggaaacacagaaatctaggattcacgcagagtttgtgcagcaaaaaaacttcctggttgaagaagaacagaggcagctgcaggagctggagaaggatgagagggagcagctgagaatcctgggggagaaagaggccaagctggcccagcagagccaggccctacaggagctcatctcagagctagatcgaaggtgccacagctcagcactggaactgctgcaggaggtgataattgtcctggaaaggagtgagtcctggaacctgaaggacctggatattacctctccagaactcaggagtgtgtgccatgtgccagggctgaagaagatgctgaggacatgtgcagtccacatcactctggatccagacacagccaatccgtggctgatactttcagaagatcggagacaagtgaggcttggagacacccagcagagcatacctggaaatgaagagagatttgatagttatcctatggtcctgggtgcccagcactttcactctggaaaacattactgggaggtagatgtgacaggaaaggaggcctgggacctgggtgtctgcagagactctgtgcgcaggaaggggcactttttgcttagttccaagagtggcttctggacaatttggttgtggaacaaacaaaaatatgaggctggcacctacccccagactcccctccaccttcaggtgcctccatgccaagttgggattttcctggactatgaggctggcatggtctccttctacaacatcactgaccatggctccctcatctactccttctctgaatgtgcctttacaggacctctgcggcccttcttcagtcctggtttcaatgatggaggaaaaaacacagcccctctaaccctctgtccactgaatattggatcacaaggatccactgactattgatggctttctctggacactgccactctccccattggcaccgcttctcagccacaaaccctgcctcttttccccatgaactctgaaccacctttgtctctgcagaggcatccggatcccagcaagcgagctttagcagggaagtcacttcaccatcaacattcctgccccagatggctttgtgattccctccagtgaagcagcctccttatatttggcccaaactcatcttgatcaaccaaaaacatgtttctgccttctttatgggacttaagttttttttttctcctctccatctctaggatgtcgtctttggtgagatctctattatatcttgtatggtttgcaaaagggcttcctaaaaataaaaaataaaatttaaaaaactgtgaaaaaaaaaaaaaaaaa

SEQ ID NO: 328 - DNA, 4684 bp, Human
ggttgtcgggatgggggcgggagccaacatagagccctcagtgggatgagggtgaaactgctattgccggcggctcctgttttaccgcgtcagcatgctggtgcatttatttcgggtcgggattcggggtggcccattcccaggcaggctgctaccgcccctccgcttccagacattctcagctgtcaggtactctgatggctaccgcagctcctccctcctccgggccgtggcccacctgcggtcccagctctgggcccacctccctcgagcccccctagctcccagatggagcccctctgcctggtgctgggttgggggagccctgctaggccccatggtactgagtaagcatccccacctctgccttgtggccctgtgtgaggcagaagaggcccctcctgccagctccacaccccatgtcgtggggtctcgctttaactggaagctcttctggcagtttctgcacccccacctgctggtcctgggggtagccgtcgtgctggccttgggtgcggcactcgtgaatgtacagatccccctgctcctgggccagctggtagaggtcgtggccaagtacacaagggaccacgtagggagtttcatgactgagtcccagaatctcagcacccacctgcttatcctctatggtgtccagggactgctgaccttcgggtacctggtgctgctgtcccacgttggcgagcgcatggctgtggacatgcggagggccctcttcagctccctgctccgacaagacatcaccttctttgacgccaataagacagggcagctggtgagccgcttgacaactgacgtgcaggagtttaagtcatccttcaagcttgtcatctcccaggggctgcgaagctgcacccaggtggcaggctgcctggtgtccctgtccatgctgtcgacacgcctcacgctgctgctgatggtggccacaccagccctgatgggagtgggcaccctgatgggctcaggcctccgaaaattgtctcgccagtgtcaggagcagatcgccagggcaatgggcgtagcagacgaggccctgggcaatgtgcggactgtgcgtgccttcgccatggagcaacgggaagaggagcgctatggggcagagctggaagcctgccgctgccgggcagaggagctgggccgcggcatcgccttgttccaagggctttccaacatcgccttcaactgcatggtcttgggtaccctatttattgggggctcccttgtggccggacagcagctgacagggggagacctcatgtccttcctggtggcctcccagacagtgcaaaggtccatggccaacctctctgtcctgtttgggcaggtggtccgggggctgagtgcaggtgcccgggtctttgagtacatggccctgaacccctgcatcccactgtctgggggctgctgcgtccccaaagagcagctgcgtggctccgttacatttcagaacgtctgcttcagctacccctgccgccccggcttcgaggtgctgaaagacttcaccctgacgctgccccctggcaagatcgtggccctcgtgggccagtctggcggaggaaagaccaccgtggcttccctgctggagcgcttctacgaccccacggcaggcgtggtgatgctggatgggcgggacctgcgcacccttgacccctcctggctccggggccaggttgtcggcttcatcagccaggagcccgtcctgtttgggacgaccatcatggaaaacatccgctttgggaagctggaagcttccgatgaagaggtgtacacagccgcccgggaagcgaatgctcacgagttcatcaccagcttccccgagggctacaacacggtcgtcggtgaacggggcactaccctgtctgggggccagaagcagcgcctggccatcgcccgagcccttatcaagcagcccacggtgctgatactggatgaagctaccagcgcgctggatgcagagtccgagcgggttgtacaggaggccctggaccgggccagtgcaggccgcacggtgctggtaattgcccaccggctcagcactgtccgtggggcccactgcattgtcgtcatggccgatggccgtgtctgggaggctgggacacatgaagagctcctgaagaaaggcgggctatacgccgagctcatccggaggcaggccctggatgccccgaggacagcggccccaccgcccaaaaagccagaaggccccaggagccaccagcacaagtcctgagaagggccccctgaggtgtggtcgctgccaagcatcagtgttagggctggggctcagcctgggggagcctactggggactgagcccccaggagggccagcatgtggagagtcgctgcggctgctcctgctcacaataaagccggggccgagcagctggcaggggaggccaatccctccctcccctccccagtcctgccggctgcctccctcccaccagagtctgccagagtcattgggctgcaatgggcagagacagagttccacgagacacctccactctattctccctttgcccagacccctccagacctctcaagagacgttctggccagtctccctgccccacccagcagcttcaaattggccaggcctacagtagctccagggaatttttaaaaatcagggtctggaagtgggcctgggaattcaaacctaggctcttcccacacccttgctaggacctcacttccctagactggcgactgactccctctcctgtgtccccactccctccatgggagaaggagcctatcccctggctcaccccgggacccacagtccccatcttccaaacaacctccctcctttctccctgcacagtgaacacagtcctgatttctagatttcacctcccctccccacccacaagggacacaggcctaacagggcccaacacttgggtcagggtaggagggacggggccacaatggccagttcccacgagaagcgccagcctgcctggctgtcttccaccggccctgccctgtgtgcctggcgtctttcacccactgagattgtgaaccagcctccatctacaccaagaacacccagcactgaaggagatgggaggggctgatgcccacctggagctctctgcttcctgcccacagtgctgacgagtacagagctaaatggagcagctactgcagaatccagtacagaatcggtccaggagggtgcggctgtggacaggccagcatccccagcaggttctgggaggcgcaccttgaaaggggaaggcagacatcctgagtgatgggcgcctgtggccctgagactgtggatgagggggctaggctccagctggcttctgaggggcctggaaaggcacacaagtaggtccttggctgaactggtgccccagcaggacctcgtgtccctgcactgctgcagatgcatcagccctccccatgttggtgccgctgtcacttcctactgggatccttcccctatccagccacatccaggctgtgggactacacggtgccctgttcccctgggcaggagaagaggtggtacctgcaatgcaccttcacagccaggcaagcattctggatttaccctgtgtaaagaagggtggtaccctctttcaggggtgtgatacagtgcattgatggagcagctggtgctgctgggaggccagcctggaagaggcagcagtggctcaagtttgcgtgcaggagccagagtgggacccacgggctcttgtgggtgtggtttagaactagatggtgctttggggacaagccatccaaaaaccccaggcccacatccaccctgatttgatatcccacttcctgacagatcagaggctgtgtctttaagcagtggaggtccaggagcagagcctggggctggttcacagctaaacccctccttagggcagcccagagtagggcctcagctggcaagtccacaagccctgctggggccctgcttgttggcctgacccctccctcaccaggcagccagccaaggtggttcctgcttcacccactcagtcatcagcctcaggctgcccaaaatgcctctgacaccagatttatatcttctgggcggcttctttaaatccagcccttcacccgccccctagagaagcagtgaaaccccttggctagtccagctggaagagctagaccgcaggagccgcgccgtcttcctaacctcgcctcggccttcgctccacagtggagagtgggagcctagctgtgcttgatgctgaatgcctgttttgagagtgtgagtgggatcatctacagtaaatacttgcaaagcatggcactgtggctctggggagctggtacgcctgtgctgtaaccatggtactcagtccttccaaagtgtttattaatcaagcacctgtcatgtgccattgagcccacgatggggaatgaggacagtccctgcccccatgaagcttgtgtcctgttgggaggacagacaggtggcccagcagttgcagcatggtgtgtgcacacgtttggctggtggaaccatgtttctaccactcatggtcaaaaaaagcccaccaaagtcctgggagttcacatctgtgtgatgatacggcaacattgtttgtaatggaaagactggacacccccagtgcccatcagtgggggagtcattaaataaactatggtatgtgcacataa

SEQ ID NO: 329 - DNA, 1551 bp, Human
gggcgtctccgccgcagctcggctcccgcgcgctcagcaccgccagcggcggccagatgcaggcggagcgaggagctcggggaggccgtgggcggcggccaggccgcggccggcctggcggagatcgccacagcgagcggcccggagccgcagcggcggtagccagaggcggcggcggaggcggcggcggggacggaggcggacgccggggccgtggccgtggccggggcttccgcggcgctcgcggaggccgaggaggaggaggcgccccgcgaggcagccgccgggagccgggaggctggggcgcaggggccagcgcgccggttgaagatgacagcgatgcagagacctatggagaagagaatgatgaacagggaaattattctaaaagaaagattgtctctaactgggatcgatatcaagatattgaaaaagaggtcaataatgaaagtggagagtcacagaggggaacagatttcagtgtcctccttagctctgcaggggactcattctcacagttccggtttgctgaggagaaagaatgggatagtgaagcttcttgtccaaaacagaattcagcattttatgtggatagtgagttattggttcgagcccttcaagagctgcctctctgcctccgactcaacgttgctgccgaactggtccagggtacagttcctttagaggttcctcaggtgaaaccaaagagaactgatgatggcaagggattagggatgcagttaaaggggcccttggggcctggaggaagggggcccatctttgagctgaaatctgtggctgctggctgccctgtgttgctgggcaaagacaacccaagcccgggtccttcaagggattctcagaaacccacttccccactgcagtcagcaggagaccatttggaagaagaactagatctgttgcttaatttagatgcacctataaaagagggagataacatcttaccagatcagacgtctcaggacctgaaatccaaggaagatggggaggtggtccaagaggaagaagtttgtgcaaaaccatctgtgactgaagaaaaaaacatggaacctgagcaaccaagtacctccaaaaatgttaccgaggaagagctggaagactggttggacagcatgatttcctaaaaaggggaaaaaaagtgcctgaagcaaatcttggttgccttctaacggcaggtgggcataaggctgtccttcaggaccagccagtttacaagcatgtctcaagctagtgtgttccattatgctcacagcagtaaatgcctacctctgtgtttgacatctgaaagaatacattgaagcagcttgttgcatttgtttttctggcttagtaatctaatagatttccttaagggcaggagatagactctggcccttgtttctagcctccttccttgcagtgtttacaacatagccagtgtttacagcatagcagatgctgctgctgattaagagaatagatgcaaacaaggcatgcatttggccaaaataaacaaatgctggtctgtccaaaaaaaaaaaaaaaaaaaaa

SEQ ID NO: 330 - DNA, 1721 bp, Human
gccgtccccgccgccgctgcccgccgccaccggccgcccgcccgcccggctcctccggccgcctccgctgcgctgcgctgcgctgcctgcacccagggctcgggagggggccgcggaggagtcgccccccgcgcccggcccccgcccgccgcgcccgggcccgcgccatggggctctggctgtcgccgccccccgcgccgccgggctagggcgatgcgggcgcccccggcgggcggccccggcgggcaccatgagccctctgctccgccgcctgctgctcgccgcactcctgcagctggcccccgcccaggcccctgtctcccagcctgatgcccctggccaccagaggaaagtggtgtcatggatagatgtgtatactcgcgctacctgccagccccgggaggtggtggtgcccttgactgtggagctcatgggcaccgtggccaaacagctggtgcccagctgcgtgactgtgcagcgctgtggtggctgctgccctgacgatggcctggagtgtgtgcccactgggcagcaccaagtccggatgcagatcctcatgatccggtacccgagcagtcagctgggggagatgtccctggaagaacacagccagtgtgaatgcagacctaaaaaaaaggacagtgctgtgaagccagacagccccaggcccctctgcccacgctgcacccagcaccaccagcgccctgacccccggacctgccgctgccgctgccgacgccgcagcttcctccgttgccaagggcggggcttagagctcaacccagacacctgcaggtgccggaagctgcgaaggtgacacatggcttttcagactcagcagggtgacttgcctcagaggctatatcccagtgggggaacaaagaggagcctggtaaaaaacagccaagcccccaagacctcagcccaggcagaagctgctctaggacctgggcctctcagagggctcttctgccatcccttgtctccctgaggccatcatcaaacaggacagagttggaagaggagactgggaggcagcaagaggggtcacataccagctcaggggagaatggagtactgtctcagtttctaaccactctgtgcaagtaagcatcttacaactggctcttcctcccctcactaagaagacccaaacctctgcataatgggatttgggctttggtacaagaactgtgacccccaaccctgataaaagagatggaaggagctgtccctgcctgtgtcactgtttgtcactgtccaggctggctggtttgggcatgaatgtctgcatcactaaatccagagcttgtcttgctccctcattgtgcagatggaggaaatgaggactaaggccccacagcagatcccaggcagggccagaattatgtattcatcactttcaagttattgccacgcatgggagtcagggatagcccagtcaatacagactgcctgccctcctgctcttcaccagggttcttttctagaaggagacagccttctgtggccagagagcttggggtaggacccagatctactgagtgaccttgcttgtcactacccctgcctctctgagcagcagtttccacatgtgcacatagagggaacagaagattgctgtggttggcgtcctcgggccccagagaagtttgagactatctttacgtaatagaaaagaacacttgttcttcctgccaggcaaaaaaaaaaaaaaaaaa

SEQ ID NO: 331 - DNA, 900 bp, Human
tttcttccttctggctggccggccgcagggtagggggtccgtggacctcccggcctgtagggggcgtcgggcgcagcggaagggcctgctccggagcctggccagggctgcgcagtcatgatcaccgagaccgcggcggagcctacggtccctgcagtgcctgctgctgaggaggccaccgaagctcggggacgcgaggagccggcgtggccctggaaagacgccccgatccggacgctggtgcagcgcatccaccagctgcaggctgagcgcgcgcagggcttccgccgactggaggagtggttggcgccggtgcagggcctgagagcctgggggcgcggcctcagggtccccacatgccgcagaggccaccgccagtacctgcgcagcggccctgactacgacttcgcgcgctaccggagcacagtgcacggggtgacccaggccttcgccgccgcctcgcgggaggtgctggcggtggaagcagagctgggcgggcctcgcaggcagccgctgctcgccggccacgtgcgcagcctgcaggagctggagcagacgcggctgggcacggtggccctgctgcagttgatggagacgccagagctggcggggcaggaggacgctgtacggatgcagcagctgaaaatgaaggtaattaaaaccatggaggcgatcagcgaggttctccaggaccttaggtttgatgcggaatctgccgagtgatggcggctccccagggatgcgccgagggagatgggaaacggggcggatggcgcccagcccagccctaactgccagctggctggggttgcgccccactgcgctgctgaccttcctgcagttccagacacctcccacaataaagagctcctcctctgtaaaaaaaaaaaaaaaaaaaaa

SEQ ID NO: 332 - DNA, 1352 bp, Human
cgtgaagtgggcggagcgagcgatttgaacgcgagcggcgcggacttctgccaagcaccggctcatgtgaggctcgcggcacagcgttctctgggctccccagaagccagcctttcgctcccggacccggcagcccgagcaggagccgtgggaccgggcgccagcaccctctgcggcgtgtcatgggcccgcgccgccggagccgaaagcccgaggccccgaggaggcgcagcccgagcccgaccccgacccccggcccctcccggcggggcccctccttaggcgcttcctcccatcaacacagtcggcggagacaaggttggctaaaggagatccgaaagcttcagaagagcacacacctcttgataaggaagctgcccttcagccgcctggcagcagaagcatttctagttcatctctttgaggacgcctatctcctcaccttacatgcaggccgagttactctcttcccaaaggatgtgcaactggcccggaggatccggggccttgaggagggactcggctgagctcctgcacccagtgtttctgtcagtctttcctgctcagccaggggggatgataccggggactctccagagccatgactagatccaatggattctgcgatgctgtctggactttgctgtctctgaacagtatgtgtgtgttgctttaaatatttttcttttttttgagaaggagaagactgcatgactttcctctgtaacagaggtaatatatgagacaatcaacaccgttccaaaggcctgaaaataattttcagataaagagactccaaggttgactttagtttgtgagttactcatgtgactatttgaggattttgaaaacatcagatttgctgtggtatgggagaaaaggctatgtacttattattttagctctttctgtaatatttacattttttaccatatgtacatttgtacttttattttacacataagggaaaaaataagaccactttgagcagttgcctggaaggctgggcatttccatcatatagacctctgcccttcagagtagcctcaccattagtggcagcatcatgtaactgagtggactgtgcttgtcaacggatgtgtagcttttcagaaacttaattggggatgaatagaaaacctgtaagctttgatgttctggttacttctagtaaattcctgtcaaaatcaattcagaaattctaacttggagaatttaacattttactcttgtaaatcatagaagatgtatcataacagttcagaattttaaagtacattttcgatgcttttatgggtatttttgtagtttctttgtagagagataataaaaatcaaaatatttaatgaaaa

SEQ ID NO: 333 - DNA, 3349 bp, Human
gggggagtgttgttagcgcgcgccttccggatcgcagctctcgcggcagtcgcctgagacttaaggttattgcttggccgcggcctggtattccggcgattcgtttcttgctcggcttcctggagctgtggtccgtgtgggcttccacctcagacagttgcgctggctcagcggggccggaacatggctgcgtccggtctggatcatctcaaaaatggctacagaagaagattttgtcgaccttccagggcacgtgacattaacacagagcaaggccagaatgttctggaaatcttacaagactgttttgaagaaaaaagtcttgccaatgattttagtacaaattctacaaaatcagtgcctaattcaacacgcaaaataaaagacacttgtattcagtcaccaagcaaagagtgccagaaatcacatccaaagtcagttccagtttcttcaaagaagaaagaagcctctctacagtttgttgtagaaccaagtgaagccacaaacagatcagttcaggcccatgaagttcatcagaaaattctggcaactgatgttagttccaaaaatacacctgactcgaaaaaaatatcaagtagaaacataaatgatcatcacagtgaagctgatgaagaattttacttatccgttggctcaccttctgttcttttggatgcaaaaacatctgtatcacaaaatgttattccatctagtgcccaaaagagagagacttacacttttgaaaattcagtaaatatgctgccttcaagtacagaggtttcagttaaaaccaaaaaaaggttaaactttgatgataaagttatgttaaagaaaatagaaatagataataaagtatcagatgaagaggataaaacatcggaaggacaagaaagaaaaccatcaggatcatctcagaatagaatacgagattcagaatatgaaattcaacgacaagctaaaaaaagtttttcaacattgtttttagaaacagtaaaacgaaaaagtgaatccagtcccattgttaggcatgcggcaactgctccacctcattcgtgtcctcccgatgatacgaagttgatagaggatgaatttataattgatgagtcggatcaaagttttgccagtagatcttggattacaataccaagaaaggcagggtctctgaaacaacgcacaatatccccggctgagagcactgcactccttcaaggtagaaagtcaagagaaaagcatcataatatattacctaagactttggcaaatgacaaacattcccataaacctcacccagtagagacatctcagccctctgataaaacagtactggatacaagttatgctttgataggtgaaacagtaaataattatagatctacaaaatatgaaatgtattccaagaatgcagaaaaaccatctagaagcaaaaggactataaaacaaaaacagagaagaaaattcatggctaaaccagctgaagaacagcttgatgtgggacagtctaaagatgaaaacatacatacatcacatattacccaagacgaatttcaaagaaattcagacagaaatatggaagagcatgaagagatgggaaatgattgtgtttccaaaaaacagatgccacctgtgggaagcaagaaaagtagcactagaaaagataaggaagaatctaaaaagaagcgcttttccagtgagtccaagaacaaacttgtacctgaagaagtgacttcaactgtcacgaaaagtcgaagaatttccaggcgtccatctgattggtgggtggtaaaatcagaggagagtcctgtttatagcaattcttcagtaagaaatgaattaccaatgcatcacaatagtagccgaaaatctactaagaaaacaaatcagtcatctaagaatattaggaaaaaaactattccacttaaaaggcagaagacagcaactaaaggcaaccaaagagtacagaagtttttaaatgctgaaggttctggaggtatcgttggtcatgatgaaatttccagatgttcgctgagtgagccattggaaagtgatgaggcagacttggctaagaagaaaaatcttgattgttctagatctacaagaagctcaaagaatgaagataacattatgactgcacagaatgttcccctaaagcctcagaccagtggatatacatgtaatataccaacagagtcaaacttggattctggagagcataagacttcagttttagaggaaagtggaccttccaggctcaataataattatttaatgtctggaaagaatgatgtggatgatgaggaagttcatggaagttcagatgactcaaaacaatctaaagtgataccaaagaacagaatccatcacaaactagtattgccctccaacacaccaaatgttcgcaggaccaagagaacacgtttgaaacctttggagtactggcgaggagagcgaatagattatcaaggaaggccatcaggaggattcgtgattagtggagtactatctccagacacaatatcgtctaaaaggaaggcaaaagaaaatattggaaaagtcaacaaaaaatctaataagaaaaggatctgtcttgataacgatgaaagaaagactaacttaatggtaaatctaggtatacctcttggagatcctttgcagccaacgagggtaaaggacccagaaacaagagagattattctcatggatcttgtaaggccacaagatacatatcaattttttgttaagcatggtgagttgaaggtatacaagacattggatacaccctttttttctactgggaaattgatattaggaccacaagaagaaaagggaaagcagcatgttggccaggatatattggttttttatgttaactttggtgaccttttgtgtactttacatgaaacaccttatatattaagtactggggattcgttctatgttccttcaggtaactattataacatcaaaaatctccggaatgaggaaagtgttcttctttttactcagataaaaagatgaaagatcaaccaaccttaaatatatgtatgtatatatgtatatgtgaaaaacagtttgtatagttggaatatttgtctttgtaattacttgtgatgttttaaaataaaaattttattcagttttctgtagacttgtatttgataaacatttctaactcacatgttttttctgatttttcagtgactgtacataatagcttgtagcgatgtccatatttatgatattatttttataatttgacaagaatatgaaaatgaaatatagaacatttctgtgtcaaaagagacctgattaatatgtctactcattaaaaaacatcttttccaaatactaa

SEQ ID NO: 334 - DNA, 2360 bp, Human
acccatgctgactctggagcgggccgggtggcgctgcccatccccggatccttcgtagatggagtcttgcttagtcgcccaagctggagtagtgtggctcgatctcagctctgcaacctctgcctcccagggttcaagcaattctcctgcctcagtttccagagtagctggaattatagtgcagattctgggaaagtgaactccacggaagactcagaaaccaagttctaattcagttgccatgaaaacttaaggtgagaggattgtcaaccagtgaaaaatacggaggaaaacactaacagaatatgatgaagaagccaagacttgggctgcttgcattacattaaccgaggtttacccgcagcgaggctgcctccaaagcatccggagtttgcaaccatcactgtccaccccgcgagctgcgatagtgcgagaactacaattcccgtggggctgtgcgggagcatcgcgagagttacattaactgtggcggcgggaaggcggagcctgcagctggctgggcggttaggagggcccggggccgagacgatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccaggaagttgagtggccaaacaaggacgatagccagagggcgttcccatggagccaggtctgttggcagatcggcccatattcaggccagtgggcacttggaggaacagacacctcggacgctgctgaagaacatcctactaactgccccagaatcttccatcctgatgcctgagtcggtagtgaagccagtgccagcaccgcaggcggtccaaccctccagacaagagagcagttgcggcagcctggagctgcaacttcctgagctcgagccccccacaaccctggctccaggtctgctggcccctggcaggaggaaacagaggctgagactgtcagtgtttcagcagggagtggaccaggggctgtctctctcccaagagcctcaagggaatgctgatgcctcttccctcaccagatccctcaacctgacctttgccacacctcttcagccacagtcagtgcagaggcctggcttggcccgcagacctccagcccgccgagctgtagacgtgggtgcctttttgcgggatctgcgagatacttccctggctcctccaaacattgtgttggaggacacccagccgttctctcagcccatggttggctcccccaacgtgtatcactccctgccctgcacgcctcacactggggctgaagacgctgagcaggctgccggtcgcaagacacagagcagtgggcctgggctgcagaagaatagccctgggaaaccagcccagtttctggcaggagaggcagaggaggtcaatgcctttgctctgggcttcctgagcaccagcagtggtgtctctggagaagatgaagtagagcccttacacgatggagttgaagaggcagagaaaaagatggaagaagaaggtgtgagtgtgagtgaaatggaggcaacaggagcacaaggacccagcagggtagaagaggctgagggacacacagaggtgacagaagcagagggatcccaggggactgctgaggctgacgggccaggagcatcttcaggggatgaggatgcctctggcagggcagcaagtccagagtcggcctccagcacccctgagtctctccaggccaggcgacatcatcagtttcttgagccagccccagcgcctggtgctgcagtcttatcttcagagcctgcagagcctctgttggtcaggcatccccctaggccccggaccaccggccccaggccccggcaagatccccacaaggctggactgagccactatgtgaaactctttagcttctatgccaagatgcccatggagaggaaggctcttgagatggtggagaagtgcctagataaatatttccagcatctttgtgatgatctggaggtatttgctgctcatgctggccgcaagactgtgaagccagaggacctggagctgctgatgcggcggcagggcctggtcactgaccaagtctcactgcacgtgctagtggagcggcacctgcccctggagtaccggcagctgctcatcccctgtgcatacagtggcaactctgtcttccctgcccagtagtggccaggcttcaacactttccctgtccccacctggggactcttgcccccacatatttctccaggtctcctccccacccccccagcatcaataaagtgtcataaacagaaaaaaaaaaaaaaaaa

SEQ ID NO: 335 - DNA, 2757 bp, Human
gggcaatggcgggcgcccctcccccagcctcgttgccgccttgcagtttgatctcagactgctgtgctagcaatcagcgagactccgtgggcgtaggaccctccgagccaggtgtgggatatagtctcgtggtgcgccgtttcttaagctggtctgaaaagcgcaatattcgggtgggagtgacccgattttccaggtgcttccgtcacccctttctttgactcggaaagggaactccctgaccccttgcgcttcccaggtgaggcaatgcctcgccctgcttcggctcgcgcacggtgcgcgcacacactggcctgcgcccactgtctagcactccctagtgagatgaacccggtacctcagatggaaatgcagaaatcacccgtcttctgcgtcgctcacgctgggagctgtagaccggagctgttcctattcggccatcttggctcctagtatttttaattaagcacttgtgttctgattagtggccaaataaatgacagtcagaacttcagctaaggtacaataaggttttgctgtggcgtggcacctggtctctttctagaaggaaagttcaacatacagcacaattctggacacattgtattggtttgatgctcctacctggaacaggtggagctggtctcttgggcagcctgacatctggtccactcctctgtcctatgccgggatcatcatgaccgtagagattatgtcactgttttgcatccttgttacataactcagttcctggtagattactatgtcagagagtcacaatgaccttgcacaataacagtacaacctcgcctttgtttccaaacatcagctcctcctggatacacagcccctccgatgcagggctgcccccgggaaccgtcactcatttcggcagctacaatgtttctcgagcagctggcaatttctcctctccagacggtaccaccgatgaccctctgggaggtcataccgtctggcaagtggtcttcatcgctttcttaacgggcatcctggccttggtgaccatcatcggcaacatcctggtaattgtgtcatttaaggtcaacaagcagctgaagacggtcaacaactacttcctcttaagcctggcctgtgccgatctgattatcggggtcatttcaatgaatctgtttacgacctacatcatcatgaatcgatgggccttagggaacttggcctgtgacctctggcttgccattgactacgtagccagcaatgcctctgttatgaatcttctggtcatcagctttgacagatacttttccatcacgaggccgctcacgtaccgagccaaacgaacaacaaagagagccggtgtgatgatcggtctggcttgggtcatctcctttgtcctttgggctcctgccatcttgttctggcaatactttgttggaaagagaactgtgcctccgggagagtgcttcattcagttcctcagtgagcccaccattacttttggcacagccatcgctgctttttatatgcctgtcaccattatgactattttatactggaggatctataaggaaactgaaaagcgtaccaaagagcttgctggcctgcaagcctctgggacagaggcagagacagaaaactttgtccaccccacgggcagttctcgaagctgcagcagttacgaacttcaacagcaaagcatgaaacgctccaacaggaggaagtatggccgctgccacttctggttcacaaccaagagctggaaacccagctccgagcagatggaccaagaccacagcagcagtgacagttggaacaacaatgatgctgctgcctccctggagaactccgcctcctccgacgaggaggacattggctccgagacgagagccatctactccatcgtgctcaagcttccgggtcacagcaccatcctcaactccaccaagttaccctcatcggacaacctgcaggtgcctgaggaggagctggggatggtggacttggagaggaaagccgacaagctgcaggcccagaagagcgtggacgatggaggcagttttccaaaaagcttctccaagcttcccatccagctagagtcagccgtggacacagctaagacttctgacgtcaactcctcagtgggtaagagcacggccactctacctctgtccttcaaggaagccactctggccaagaggtttgctctgaagaccagaagtcagatcactaagcggaaaaggatgtccctggtcaaggagaagaaagcggcccagaccctcagtgcgatcttgcttgccttcatcatcacttggaccccatacaacatcatggttctggtgaacaccttttgtgacagctgcatacccaaaaccttttggaatctgggctactggctgtgctacatcaacagcaccgtgaaccccgtgtgctatgctctgtgcaacaaaacattcagaaccactttcaagatgctgctgctgtgccagtgtgacaaaaaaaagaggcgcaagcagcagtaccagcagagacagtcggtcatttttcacaagcgcgcacccgagcaggccttgtagaatgaggttgtatcaatagcagtgacaaaacgcacacatcaacccacagaccttaggaggaggaaggcgagggcggggtgacttctggtgatgataaaaatggttttatcacccagatgtgaaagaagctgcctgtttactgatccattgaataaacccattttaatagaaaaagtcaataccaattcagcaaaaaaaaaaaaaa

SEQ ID NO: 336 - DNA, 3789 bp, Human
agatgggagggaggctgttgcaggctctcaggggggagagatggtgctggttctgggctagaagataaaaagataaaaagaaaacccaggagacatcaaggagctggcatttcttgtagacaggattagaagatgagtatagggaagaggtatgagttaaggctaggagattaaatggtgaagccatcaactggggtgggaggcgcaggcgagagtgagctgggtggaagaagggatgatgacaagaagggataatgatagtgattggatgagctggtttggggtagctcaagaaacggggatgctaatttggggctcagggtgcgcagaagccaccggagaagacgcccttgccagggggagtggggcaagaaaaggcaggaccgcctgatataactgaggacagcgaagggtggcaggagagtagcagggcagacggtctctgggtcaggggcggggagtcacgagggagccctcggacagcgcccgggccacgcaccataagggaggagtcattgctgctcatctcgggccgctcgcggctccgagtccgggtctggtggggcggtgcagagcgggattcccgaggcagggtcgtgggcactctatcgcggcgggcggttgaaggcgttacagtccttggaaaccgagctgctagccggttgctaggagcgtccagtgtctggagtgggaggaacaaaacgcctcacgtcacaaggcgcaggaatcgagcgccgagagagcgagtcggtgctactggcgtcgggtcggtccgggtaggcgcagcgggactggacctgggtgccgagcggagccgctgccatgggcctgggcgtcagcgctgagcagcccgcaggcggcgccgagggcttccacctccacggggtgcaggagaactccccagcccagcaggcgggcctggagccctactttgacttcatcatcaccattgggcactcgaggctgaacaaggagaatgacaccctgaaggcactactgaaagccaatgtggagaagcccgtgaagctggaggtgttcaatatgaagaccatgagggtgcgcgaggtggaggtggtgcccagcaacatgtggggcggccagggcctactgggtgccagtgtgcgcttctgcagcttccgcagggccagtgagcaggtgtggcatgtgctggatgtggaaccatcttcacctgctgcccttgccggcctgcgcccctacacagactatgtggttggttcggaccagattctccaggagtccgaggacttctttacgctcatcgagtctcatgaggggaagcccttgaagctgatggtgtataactccaagtcagactcctgccgggaggtgactgtaactcccaacgcagcctggggtggagagggcagtctgggatgtggcattggctatgggtatctacaccggatcccaactcagccccccagctaccacaagaagccacctggcaccccaccaccttctgctctaccacttggtgccccaccacctgatgctctaccacctggacccacccccgaggactctccttccctggagacaggttccaggcagagtgactacatggaggccctgctgcaggcacctggctcctccatggaggatccccttcctgggcctgggagtcccagccacagtgctccagaccctgatggacttccccatttcatggagactcctcttcagcccccacctccagtgcagcgagttatggacccaggcttcctggacgtgtcgggaatttctctcttggacaacagcaatgccagtgtgtggcccagcctgccctcttccacagaactgaccaccacagctgtctcaacctcagggccagaggacatctgctccagcagcagttctcatgagcggggtggtgaggctacatggtctgggtcagagtttgaggtctccttcctggacagcccaggtgcccaagcccaggcggaccacctgcctcagctgactcttcctgacagtctcacctctgcagcctcaccagaagatgggctgtccgccgagctgcttgaagctcaggctgaggaggaaccagcaagcacagagggcctagatactgggacggaggctgaggggctggacagccaggcccagatctctaccacagaataacaccctgggctgtgacaaggcccatgatgacatttcatgaggcccagatgtgggcaggcagcccgggctgcactatgcggtcaggattccttgctgctttggtgggacatgaggcctcagtgggtggtgagagggggccatgggccttgtgggaggatatcttttggccgtgtaccctcaggtccagtgcttggtcctgctctggtcactggggcttcccaggaggcagcagggtctggtcataatccagtgtgaagatgaggtgaggaaggaaggggttgctgtccagtgttggcctggtcgctttgattcttcctgcacagctcagcccaccccatctgtactggaagggaccctggagccctgggaccaccccctttcaagtcccaaacactgagtcctctgtcatgtgtccttgtccctaggctacaatgctacacttggctcaggctgatcaccatgctagtcacaggagggagagagaggcagtgtacttgcccccatctcctggagggaggtgcgttggaaattctaggcccttcagcagagacccatttgtgcccagaccacaatatttcttcttcctcagggactacatgccacagacctgtatccccagtggcaactcctgttagctcccaaacttaaacagtgatctcttctaaatatacaaggcatctacccagccccaatagtgaataaaagtcacaaatttaagttcaacaccctaagcaatttctcaaagccagtctacctgactaggtctatccacgcacggttcccaaccccaagggggaattaggggattagattaagagtaggtaaagacccttttgttctttcctgttgtaggggaggaagctgttctccccaccccaggtgcctttggaggttaaggctaggttaggccctgcactccacctggggacggcccctcatcacctgaagtcctctgctgtgttgactggaccctcagttcccacactgctaattactatgaaagctgctctggcctcgtcttctagcttgtgcctagttgaaagtctcacctttacaggatcatttgtaatgctggtgtacatgcagggaactcacaagctgtgtcaggtatgcaggacaaggaatgtctgctctggggggcacaggccaactatatggagggagggtcccaaattagcaaacccttcatttaaagcaaacccttgtcaagcctaccagagcagctgatacgtgtgcataacagtgaggcattgtgtcctggatcgtctgggagcccagtgtcaagtctgctggaatgcaggaagtagaacagaatcgccacaggactgttctggggccagcttcccttaactctgtagcctggcagtctgacccaaagttgccctcacccaaaggttctggctcttccctccctcacttttactttcccttcccccataagttggaggataaaatgggtatcaatgctaatatttccagggagaacatgaaaccagaggtttctttctttctctgtaatctgctatgaaagaaaataacaaatgaaaataaatgtgtactacactttgaaatattttaactaaagcctttattctatacaactgtgaaatacagatttttacccttttggcattgcaaaaaaaa

SEQ ID NO: 337 - DNA, 3443 bp, Human
tcctggcggctgcgaggtttcactgcaggggcgccagtgggctcagtgacgctgcggcctccttctgcctaggtcccaacgcttcggggcaggggtgcggtcttgcaataggaagccgagcgtcttgcaagcttcccgtcgggcaccagctactcggccccgcaccctacctggtgcattccctagacacctccggggtccctacctggagatccccggagccccccttcctgcgccagccatgcctttaaaccgcactttgtccatgtcctcactgccaggactggaggactgggaggatgaattcgacctggagaacgcagtgctcttcgaagtggcctgggaggtggctaacaaggtgggtggcatctacacggtgctgcagacgaaggcgaaggtgacaggggacgaatggggcgacaactacttcctggtggggccgtacacggagcagggcgtgaggacccaggtggaactgctggaggcccccaccccggccctgaagaggacactggattccatgaacagcaagggctgcaagttcctggcacagagtgaggagaagccacatgtggttgctcacttccatgagtggttggcaggcgttggactctgcctgtgtcgtgcccggcgactgcctgtagcaaccatcttcaccacccatgccacgctgctggggcgctacctgtgtgccggtgccgtggacttctacaacaacctggagaacttcaacgtggacaaggaagcaggggagaggcagatctaccaccgatactgcatggaaagggcggcagcccactgcgctcacgtcttcactactgtgtcccagatcaccgccatcgaggcacagcacttgctcaagaggaaaccagatattgtgacccccaatgggctgaatgtgaagaagttttctgccatgcatgagttccagaacctccatgctcagagcaaggctcgaatccaggagtttgtgcggggccatttttatgggcatctggacttcaacttggacaagaccttatacttctttatcgccggccgctatgagttctccaacaagggtgctgacgtcttcctggaggcattggctcggctcaactatctgctcagagtgaacggcagcgagcagacagtggttgccttcttcatcatgccagcgcggaccaacaatttcaacgtggaaaccctcaaaggccaagctgtgcgcaaacagctttgggacacggccaacacggtgaaggaaaagttcgggaggaagctttatgaatccttactggttgggagccttcccgacatgaacaagatgctggataaggaagacttcactatgatgaagagagccatctttgcaacgcagcggcagtctttcccccctgtgtgcacccacaatatgctggatgactcctcagaccccatcctgaccaccatccgccgaatcggcctcttcaatagcagtgccgacagggtgaaggtgattttccacccggagttcctctcctccacaagccccctgctccctgtggactatgaggagtttgtccgtggctgtcaccttggagtcttcccctcctactatgagccttggggctacacaccggctgagtgcacggttatgggaatccccagtatctccaccaatctctccggcttcggctgcttcatggaggaacacatcgcagacccctcagcttacggtatctacattcttgaccggcggttccgcagcctggatgattcctgctcgcagctcacctccttcctctacagtttctgtcagcagagccggcggcagcgtatcatccagcggaaccgcacggagcgcctctccgaccttctggactggaaatacctaggccggtactatatgtctgcgcgccacatggcgctgtccaaggcctttccagagcacttcacctacgagcccaacgaggcggatgcggcccaggggtaccgctacccacggccagcctcggtgccaccgtcgccctcgctgtcacgacactccagcccgcaccagagtgaggacgaggaggatccccggaacgggccgctggaggaagacggcgagcgctacgatgaggacgaggaggccgccaaggaccggcgcaacatccgtgcaccagagtggccgcgccgagcgtcctgcacctcctccaccagcggcagcaagcgcaactctgtggacacggccacctccagctcactcagcaccccgagcgagcccctcagccccaccagctccctgggcgaggagcgtaactaagtccgccccaccacactccccgcctgtcctgcctctctgctccagagagaggatgcagaggggtgctgctcctaaacccccgctccagatctgcactgggtgtggccccgcagtgcccccacccagtccgccaaacactccaccccctccagctccagtttccaagttcctgcactccagaatccacaaagccgtgcctttctctggctccagaatatgcataatcagcgccctggagtcccctgggcctggaccgcttcccagaggccaggaatctgccattactctgcggtggtgccagaggttttaggaaacctggcatggtgctttcaggtctggggcttttagagccccccgtgtggcttacaaattctacagcatacagagcaggccacgctcaggcccggcatgcgggccaccaagttctggaaaccacgtggtgtccctgcgaatggggcgatcaagtccagagccggggcactttcagagtttgaaggtaactgagagcagatggtcctccatttcaactccagaagtggggctctgggagggatgttctagccctccctggcatgtcagagccaggctctgcctggaggatccctccatccggctcctgtcatcccctacactttggccaagcaagaggtggtagaaccacttggctgctcattccttctggaggacacacagtctcagtccagatgccttcctgtctttctggccctttctggaccagatcctactcttcctttctaaatctgagatctccctccagggaatccgcctgcagaggacagagctggctgtcttcccccacccctaacctggcttattcccaactgctctgcccactgtgaaaccactaggttctaggtcctggcttctagatctggaaccttaccacgttactgcatactgatccctttcccatgatccagaactgaggtcactgggttctagaacccccacatttacctcgaggctcttccatccccaaactgtgccctgccttcagctttggtgaaagggagggcccctcatgtgtgctgtgctgtgtctgcaccgcttggtttgcagttgagaggggagggcaggaggggtgtgattggagtgtgtccggagatgagatgaaaaaaatacatctatatttaagaatcccaaaaaaaaaaaaaaaaaa

SEQ ID NO: 338 - DNA, 5327 bp, Human
cgaatgttgttgttggtggcggcggcgagcggagccggaggagccgccgcaaagatggaggagccgtcgaggaggtgctgccgccgctgccgccgccgctgctgccgccgccgcccgcgaagccggagctcgagccgcagcggggatgccgttctgagtgcctgactgcctcgccccgaaggatggcctcggatgggcattagaggcacggcggccccgggctcccgtcccgtccgtctgtctgttatcgtctgtctctcttgacatcaccgcagctccaccccctcccgtcccagcccccaacgccagcttcctgcaggcccagagccggcatgaactctcccaacgagtcggcagatgggatgtcaggtcgggaaccatccttggaaatcctgccgcggacttctctgcacagcatccctgtgacagtggaggtgaagccggtgctgccaagagccatgcccagttccatggggggtgggggtggaggcagccccagccctgtggagctacggggggctctggtgggctctgtggaccccacactgcgggagcagcaactgcagcaggagctcctggcgctcaagcagcagcagcagctgcagaagcagctcctgttcgctgagttccagaaacagcatgaccacctgacaaggcagcatgaggtccagctgcagaagcacctcaagcagcagcaggagatgctggcagccaagcagcagcaggagatgctggcagccaagcggcagcaggagctggagcagcagcggcagcgggagcagcagcggcaggaagagctggagaagcagcggctggagcagcagctgctcatcctgcggaacaaggagaagagcaaagagagtgccattgccagcactgaggtaaagctgaggctccaggaattcctcttgtcgaagtcaaaggagcccacaccaggcggcctcaaccattccctcccacagcaccccaaatgctggggagcccaccatgcttctttggaccagagttcccctccccagagcggcccccctgggacgcctccctcctacaaactgcctttgcctgggccctacgacagtcgagacgacttccccctccgcaaaacagcctctgaacccaacttgaaagtgcgttcaaggctaaaacagaaggtggctgagcggagaagcagtcccctcctgcgtcgcaaggatgggactgttattagcacctttaagaagagagctgttgagatcacaggtgccgggcctggggcgtcgtccgtgtgtaacagcgcacccggctccggccccagctctcccaacagctcccacagcaccatcgctgagaatggctttactggctcagtccccaacatccccactgagatgctccctcagcaccgagccctccctctggacagctcccccaaccagttcagcctctacacgtctccttctctgcccaacatctccctagggctgcaggccacggtcactgtcaccaactcacacctcactgcctccccgaagctgtcgacacagcaggaggccgagaggcaggccctccagtccctgcggcagggtggcacgctgaccggcaagttcatgagcacatcctctattcctggctgcctgctgggcgtggcactggagggcgacgggagcccccacgggcatgcctccctgctgcagcatgtgctgttgctggagcaggcccggcagcagagcaccctcattgctgtgccactccacgggcagtccccactagtgacgggtgaacgtgtggccaccagcatgcggacggtaggcaagctcccgcggcatcggcccctgagccgcactcagtcctcaccgctgccgcagagtccccaggccctgcagcagctggtcatgcaacaacagcaccagcagttcctggagaagcagaagcagcagcagctacagctgggcaagatcctcaccaagacaggggagctgcccaggcagcccaccacccaccctgaggagacagaggaggagctgacggagcagcaggaggtcttgctgggggagggagccctgaccatgccccgggagggctccacagagagtgagagcacacaggaagacctggaggaggaggacgaggaagacgatggggaggaggaggaggattgcatccaggttaaggacgaggagggcgagagtggtgctgaggaggggcccgacttggaggagcctggtgctggatacaaaaaactgttctcagatgcccagccgctgcagcctttgcaggtgtaccaggcgcccctcagcctggccactgtgccccaccaggccctgggccgtacccagtcctcccctgctgcccctgggggcatgaagagccccccagaccagcccgtcaagcacctcttcaccacaggtgtggtctacgacacgttcatgctaaagcaccagtgcatgtgcgggaacacacacgtgcaccctgagcatgctggccggatccagagcatctggtcccggctgcaggagacaggcctgcttagcaagtgcgagcggatccgaggtcgcaaagccacgctagatgagatccagacagtgcactctgaataccacaccctgctctatgggaccagtcccctcaaccggcagaagctagacagcaagaagttgctcggccccatcagccagaagatgtatgctgtgctgccttgtgggggcatcggggtggacagtgacaccgtgtggaatgagatgcactcctccagtgctgtgcgcatggcagtgggctgcctgctggagctggccttcaaggtggctgcaggagagctcaagaatggatttgccatcatccggcccccaggacaccacgccgaggaatccacagccatgggattctgcttcttcaactctgtagccatcaccgcaaaactcctacagcagaagttgaacgtgggcaaggtcctcatcgtggactgggacattcaccatggcaatggcacccagcaggcgttctacaatgacccctctgtgctctacatctctctgcatcgctatgacaacgggaacttctttccaggctctggggctcctgaagaggttggtggaggaccaggcgtggggtacaatgtgaacgtggcatggacaggaggtgtggacccccccattggagacgtggagtaccttacagccttcaggacagtggtgatgcccattgcccacgagttctcacctgatgtggtcctagtctccgccgggtttgatgctgttgaaggacatctgtctcctctgggtggctactctgtcaccgccagatgttttggccacttgaccaggcagctgatgaccctggcagggggccgggtggtgctggccctggagggaggccatgacttgaccgccatctgtgatgcctctgaggcttgtgtctcggctctgctcagtgtagagctgcagcccttggatgaggcagtcttgcagcaaaagcccaacatcaacgcagtggccacgctagagaaagtcatcgagatccagagcaaacactggagctgtgtgcagaagttcgccgctggtctgggccggtccctgcgagaggcccaagcaggtgagaccgaggaggccgagactgtgagcgccatggccttgctgtcggtgggggccgagcaggcccaggctgcggcagcccgggaacacagccccaggccggcagaggagcccatggagcaggagcctgccctgtgacgccccggcccccatccctctgggcttcaccattgtgattttgtttattttttctattaaaaacaaaaagtcacacattcaacaaggtgtgccgtgtgggtctctcagccttgcccctcctgctcctctacgctgcctcaggcccccagccctgtggcttccacctcagctctagaagcctgctccctctgcagggggtggtggtgtcttcccagccctgtcccatgtgtccctccccccattttcctgcattctgtctgtccttttcctccttggagcctgggccagctcaaggtgggcacgggggcccagacagtactctccagttctggggccccccgagtgaggagggaacgggaagtcggtgccttggtttcagctgatttggggggaaatgccttaatttcactctcctcccttctccagcctcaggggaggatctggaggatccactactgtctttaagatgcagagtggaggggaggtgggcacccaccctgcgattctccaccctttccccttctttcgtcctcaccatctctgcagacccctctcctcctccttcctcttggtctcagcactgatgggaggctggtgcccaagctgtggcctgcagtctgtgaggagggctgtcttgcctcacactcctcacagcctacttccccttccccggggctgagagggtgaaagtgtgtggggaaggagaggactggtttcctgggttctcaggggccaggaggagtaacagaaccaggtctgctccccaccttactcggatggcctccctgcccctctgctggcacagcctgggcaaggggagaaggtggtccctgcagaggggctccaggctggtgagagcccccctgctgtcaggaccagattttcccagccatccagcatgctgcggggagaaggggcagaggctcacctccctcctggggccttttgttttggatcctggggatggtgagaatggaggttctagaaggggtaaggccagaacccagggatccaggagtcggctctcagctggagcttccataccttctgggctccctttgctgaccaccagcccaagggagctaagaccaggagggggctgggcgctgtcccttctctttcccaggagccctgccaggggctgtgggcctacaaggcttccaggggatgccatccagcctgtaggaaaccaaagatgggaagtggctcctagggggctgactcttccttcctcctcctccccagtaccacatatactttctctccttctatctccagggccccaccaatctgtttacatatttattatcctatgggggcctgagcaggattgagggagccaggggaggggcaggagtcccagcaccatcggttcatagtgtgcttgtgtgtttgttttagatcctcctgggggatggggatggggccaggctcagtgtactaggcctctctgtgctgagccccaggctcccggccccttacccactctctccctgtggctggtctggttctcatgtaaacccactccttgctttgtctccctggatatggatttcagttaagtattttgtaacccgttacactgtgtgtccttgtgtaaataaacttgtttctggcagtgcc

SEQ ID NO: 339 - DNA, 1480 bp, Human
ggtgactgacggcgccggccgcccctgcccgtcgcccgcccgctgctgccgcccgcccggggtgtggagcccggccgctgctcgcgggctgagtgtctgtcgctgctgccgcctccacccagcctccgccatggacctcttcggggacctgccggagcccgagcgctcgccgcgcccggctgccgggaaagaagctcagaaaggacccctgctctttgatgacctccctccggccagcagtactgactcaggatcagggggacctttgctttttgatgatctcccacccgctagcagtggcgattcaggttctcttgccacatcaatatcccagatggtaaagactgaagggaaaggagcaaagagaaaaacctccgaggaagagaagaatggcagtgaagagcttgtggaaaagaaagtttgtaaagcctcttcggtgatctttggtctgaagggctatgtggctgagcggaagggtgagagggaggagatgcaggatgcccacgtcatcctgaacgacatcaccgaggagtgtaggcccccatcgtccctcattactcgggtttcatattttgctgtttttgatggacatggaggaattcgagcctcaaaatttgctgcacagaatttgcatcaaaacttaatcagaaaatttcctaaaggagatgtaatcagtgtagagaaaaccgtgaagagatgccttttggacactttcaagcatactgatgaagagttccttaaacaagcttccagccagaagcctgcctggaaagatgggtccactgccacgtgtgttctggctgtagacaacattctttatattgccaacctcggagatagtcgggcaatcttgtgtcgttataatgaggagagtcaaaaacatgcagccttaagcctcagcaaagagcataatccaactcagtatgaagagcggatgaggatacagaaggctggaggaaacgtcagggatgggcgtgttttgggcgtgctagaggtgtcacgctccattggggacgggcagtacaagcgctgcggtgtcacctctgtgcccgacatcagacgctgccagctgacccccaatgacaggttcattttgttggcctgtgatgggctcttcaaggtctttaccccagaagaagccgtgaacttcatcttgtcctgtctcgaggatgaaaagatccagacccgggaagggaagtccgcagccgacgcccgctacgaagcagcctgcaacaggctggccaacaaggcggtgcagcggggctcggccgacaacgtcactgtgatggtggtgcggatagggcactgaggggtggcgcgcggccaggagcacgcatggtattgacttaaaaggttcattttgtgtgtgtgcacattgtgtgttttgtgtactcctgtgggactcccatggttgtaaataaaggtttctctttttttttcctaaaaaaaaaaaaaaaaaaaaaaaaaaaaaaaaaaaaaa

SEQ ID NO: 340 - DNA, 1161 bp, Human
tctgctgccgaaccccgaaagctgagggacggaggtcagtgactctggggtctcgggaacccggagacgaaggaagacaccgtgttccttaagagggagtatacgtttcctcgccatttatccaatggagtttcctcttacctacttaacaggaacagggaaagggtgtcccccaacggtacggctgccccgcctcttcctgggggcccacacgtgttacaggaagtgggtaagggtaatatggaggagcttccggcagcccccggcggctgaaagccggggcagaagtgctggtctcggtcgggattccgggcttggtcccaccgaggcggcgactgcggtaggagggaagaggttttggacgcgctggcctcccgccgctgtgcattgcagcattatttcagttcaaaatgaactatatgcctggcaccgccagcctcatcgaggacattgacaaaaagcacttggttctgcttcgagatggaaggacacttataggctttttaagaagcattgatcaatttgcaaacttagtgctacatcagactgtggagcgtattcatgtgggcaaaaaatacggtgatattcctcgagggatttttgtggtcagaggagaaaatgtggtcctactaggagaaatagacttggaaaaggagagtgacacacccctccagcaagtatccattgaagaaattctagaagaacaaagggtggaacagcagaccaagctggaagcagagaagttgaaagtgcaggccctgaaggaccgaggtctttccattcctcgagcagatactcttgatgagtactaatcttttgcccagaggctgttggctcttgaagagtaggggctgtcactgagtgaaagtgacatcctggccacctcacgcatttgatcacagactgtagagttttgaaaagtcacttttatttttaattattttacatatgcaacatgaagaaatcgtgtaggtgggttttttttttaataacaaaatcactgtttaaagaaacagtggcatagactccttcacacatcactgtggcaccagcaactacttctttatattgttcttcatatcccaaattagagtttacagggacagtcttcatttacttgtaaataaaatatgaatctcaaaagtgtcatgttatttccaa

SEQ ID NO: 341 - DNA, 2297 bp, Human
gcccgataccggtttcagagtcctgggcagcgtgcgcgctcttcctggcggctgcgcaggtgtgaaaatcacaaatgtcaaatgatggaagatccaggaatcgggacaggcgctacgatgaggtcccaagcgacctgccctatcaagataccaccataagaacccacccaactcttcatgacagtgagcgggcagtgagcgctgatcccttgccaccaccccctctcccattacagccaccattcggcccagacttctactcaagtgacacagaagaaccagctatagcgccagatctcaaaccagtaaggcgctttgtccctgactcctggaagaactttttcagagggaagaaaaaggaccccgaatgggataagccggtgtctgatatcaggtacatctccgatggagtggagtgttcaccaccagcctctccagcaagaccaaaccaccgttcgcccctcaactcctgcaaagatccctacggagggtcagaaggaacctttagttcccggaaagaggctgacgcagtgtttccccgggatccctatggatctctagaccgacacacacaaacagttcgaacatacagtgagaaggtggaggagtataacctgagatactcctacatgaagtcgtgggcaggcctgctgagaatactgggtgtggtggagctgcttttgggggccggtgtctttgcttgtgtcacagcttacattcacaaggacagtgagtggtacaacttgtttggatattcacaaccgtatggcatgggaggcgttggtggattgggcagtatgtatgggggctattactacactggccctaagaccccttttgtactcgtggttgctggattagcttggatcaccaccattattattctggttcttggcatgtccatgtattaccggaccattcttctggactctaattggtggcccctaactgaatttggaattaacgttgccttgtttattttgtatatggccgcagccatagtctatgtgaatgataccaaccgaggtggcctctgctactatccgttatttaatacaccagtgaatgcagtgttctgccgggtagaaggaggacagatagctgcaatgatcttcctgtttgtcaccatgatagtttatctcattagtgctttggtttgcctaaagttatggaggcatgaggcagctcggagacatagagaatatatggaacaacaggagataaatgagccatcattgtcatcgaaaaggaaaatgtgtgaaatggccaccagtggtgacagacaaagagactcagaagttaatttcaaggaactgagaacagcaaaaatgaaacctgaactactgagtggacacatccccccaggccacattcctaaacctatcgtgatgcccgactatgtggcaaaataccctgtgattcagacagatgatgagcgagaacgctataaagctgtgttccaagaccagttttcagagtacaaagagctgtctgcagaagttcaggctgtcctgaggaagtttgatgagctggatgcagtgatgagcagattgccacatcattcggaaagccgacaggaacatgagagaatttcaagaatccatgaagagtttaagaaaaaaaagaatgatcctacatttctggaaaaaaaagaacgctgtgattacctaaagaataaactttctcacataaagcaaagaattcaagaatatgataaagtaatgaattgggatgtacaaggttattcttaacgcttatttgaaaccactttatttttttattttattttatttttttgagatgaagtctcgctctgttacccaggctggaatgcagtggcacaatctcggctcactgcaacctccacctcccgggttcaagcaattctcctgttcaagcaattagcctccccagtagctgggattacaggcgtgcgctgccacaccccgctaatttttgtatttttagtagagacgaggtttcaccatgttggtcaggctgggaaactactttttttaaaaaatagcaagtttactatttatttactgcctttttaatgctagcctctgtggtagagaagcaagcgcttcccaaatcagcttccaattggtttaaccagtatgcaacattaaagattttactcagacatttttaaacgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 342 - DNA, 5576 bp, Human
gcggccgccgcctgccgggcctcccctcgccgcggccggccgccgcgctcccgcccgggcgcccagctatgtactccccgtactgcctcacccaggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctgaacatcccacagcagtctcagtcctggttcctctgataagatcgacaaaagaaacaacaaaatgagaagaagaggttcctcgaaaggggggagaagaaattttgagaatggaaaaatcccccagcccagcccagccccaccgaaaagcaaaaattacacgtcgtcagccactcagcccttctctcctccagcccggggacccccgcgggccccagaagcagcccagttctcagagagcccttggaaggggtctcggtggagctgtgcaccagcagccaagcagaaagaaacacgcgacatggactctgtcaagtagaggacagaaagcaagaaaggatgcagaactgccttcctccccctgaccccgccccggccttctggggaaggaacaaagtccccaaacaaagcaaccagcacaattctgaaggggcctggcctccaccctcaccccttcctaggggaaccccaccctccacacagccggagctgccctagggagcctggagggccagcttgtaaagatgatggggtttagatccctcaggctctcccctccagactccgcccttccctccctccctccctccctccctctctgccaaggctccagcttcttcccccagctgctcccgaccaggagggggagagcagcctccacttaccccaccccacccttgggctaaaagcccccaggcgggcagggggtgacccctggagctagttgcgtgtcccagaatggagggtgttctgacaccccaccctgagccgcaagagcagtcctggggccctggacccctctgtacagtccgtaggaaaaagtcggaatgctctcgacggcctcgtcccagcctgggacaggccccctttcccctctctctgcaggccaggagggcctccttcctgccacgagggaggggagtcgggccccaggtcgcccccgcccccagccctgcatgcaggtgccctcgctccgccccatcagttcctgcccctgcccctcatgcagactgccctgctggggccgggccggagggtggagcagaaaggggaccccggagccgagcgaggaggaccaggcagccgccgctgccgcgctaagccaccacctgcgcttaggtaggcgtcctgctcgccgactttcagttccttgggagggtgttgggtgtcgtccttttcaaaagtgttttggagctttctgtgccccccgactttcccccgcctccccgccccccacgtggccacttttctctggattttagctgtaatgtctttactctttatttaggggtggggcattcattgtttgggtcttttgctgttggaatgggaactcctcctccatttgagcaacttgggaacaatttggtaacacaccacaggaagtagctctcccccccagccccctcctccctcaagggagggttggggggcctgtccagagggtcttcagaagcccccctgggagggaggggaggatgagcacgcccagctcccctccagggtgtgacttggcccctctggcttgtctttctgtgccttactcctcctcctgcgtctcccgttcctggccccttcttgagtccttgtgcctctctctttctctctctttcttaattgtatgaaaacacaaagcacaggtcaggatcctctgagagaaaatcaacattgcaccacgtaggggtgggctatgggctgtatttattgtgaatctagtttgtgaggctgtggccccgagctggcggagggagggaagaggagggagtgacgggaggggaggaggtcagcgacctggggccgtagcggcaggcgaacggtgcctgctacccagctggaagccacaaggtggctggctccaggggcggcttttgttggaagttgagtgaagccctccccctgtcctcagcgtgcagccctagaggaccccagggctgaggggcagtggatcctgcgggagtctcccggggcgtggggagtaaggccccgggggtggggggccgggtgggccgggcgtgacgcgcggtcaaagtgcaatgatttttcagttcggttggctaaacagggtcagagctgagagcgaagcagaaggggctccctgtccggcccacgtgccctttccctcgacgacagtcgagggctcgggctctgtgggactgtgggagctagggtctgcggggcgcctgcccgggcgaggtcggaagctgcaggccagctgggcccgggccggagcgtgcccggcggggctgcccgggcgggcagggggtgggggctgctcctttcccaagtggtgttgtgaggggcaatgagggcaacaggagatgtggggacgtgttaggagagaaaaaaaaaaaaacaaaaatatatatgggggaaattaacttttttttttcattgaaccaagtgcaatgcatcagagagttttcctatctttgtatgttaagagattaagaaaaaaaaattctatttttgttgtaatgtcctcgcggctctggggacgctaaaagaaccgggcctgccccgccctgcgcggggataacgaaagctgagtgtttttcccttttttttgttcgtttttagtttttttttttttaagtcgttttcctgcgttgacgaggatgatctggggtttttatttgtttcgtcgttcgttctgtttcggtgggagggctgaaggaaacgttcacattttagagtttaaaaaaaacacctcgacatttaaaaaatcaaccaacacaagatcaaaaaggaaaaggacgagagaaaaattatttttaagataattaaacataaaaccctggtgcttcttacattataaagtacgttttaaagaacccacaaactattatacataagtttatgaatcaattaaatatcctgcacttgttaggaatacgcatatcccttctttgttgagtttaacggaacgggacagcggcgtgcccccggcggctggactgctccggccgcgggtctccccgggcgcccctccctggggcccagcacccctcctcgccccatccccgtccgggtacgggggcgcggcaggggtccccggcccctcccccgcagaggtcaatgccaacgaacaaacgtcccctccctccctccctctccgccccgagcgcccttctttgagccagacgccaacttgaccctcaccagcattatcaggagcgcgctcagcaagttggtagtttcctcccccctttcccggcgcccctcccgcccccattcaacatctctcatcctatccccgaccccctccggggaacaccgggaaggctcgacgctccaggacaggaccagccacgctgacaggtcgatttgcccaggcccgcgcccgcacgcacgcacgcacacggccccgcacacagccccgccccaccccgcaaccagccctgtcgactgccttatacacccgcccccgcgctggccggccgacctagtgccttgttctcacccccgtgctggcggagcggacgccgcgctctgggtcccagaggggccgggtggctcagacgacccaccactcccccaccctgaccgtgctgaacagacccccccacacgagagaaaataaaggagcaataaagtcacgagaactttcgtcccccaatcgagagcccgaggggcaccccagccccgcctctgctcccccccaccccacccaccctcggggcgcccccctccccccgcaagccagcctgggccagccccgcttcggcccctcccgggagatccgtgcgcccgaccagcaccagcatcgcggaccgcaaaggccgcccgtcccgtcaaacaagtttcttcttaggctaagaaacgcagtatatacgagtatctctatatatagtactaatggatttggtgtgcttcccccttagcgtccccctccctctgctcctcctccttcagcctggtctccccctcttctctgccctccacccccgtctctgcactgagatacataagaaacaagggtagtttactgtctgttttgttttctgggttttcagtgtcctagcggaatgcaagtaggcagccagcccgtctgttccctctccgccccgccccgccccgcccccgtcactgcgcttctgttataccatctttgcctgactctctccggcttctccattgaatggctaatgtgtatgtgaaataaagaaataaagaaaaacaaacgcga

SEQ ID NO: 343 - DNA, 4349 bp, Human
gcccccgcctcgcgccgcgcgcacgtgactgcgcccccggccccgcccccggcctgccccccgcccccactggccgctcggccgcgcgcgggtcggccggctctatggggaaagcggcggctccgagccgaggcggcggctgtggcggccgctcccgcgggctctcgtcgctgttcacggttgtcccctgcctgtcgtgccacacggcggcgccgggcatgagcgcttccacgtccggctccgggccggagcccaagccccagccccagcccgtgcccgaaccggagcggggaccgctgtcagaacaggtgtcggaggcagtttcggaggcagtgccaagatcggaacctgtgtccgagacgacgtctgagccggagccaggggctgggcagccatcggaactgctgcaggggtcgcggccggggtcagagtcaagctcaggtgtaggggctgggcccttcactaaggccgcatcggagccgctctcccgggcggtggggagcgcgacctttctcagacccgagtcaggatcgctgccagcgttaaagcccctgcctcttctgcgaccaggacaggcgaagactcctcttggggttccaatgtcggggactggcacgacctccagtgccccactggccttactgcctctggacagcttcgagggctggcttctcaagtggaccaactatctgaagggctaccagcgccgctggttcgtgctgggcaatggtttgctctcttactacagaaatcagggtgaaatggcccacacgtgccgtggaaccatcaacctgtccaccgcgcacattgacacggaggactcttgtggtatcttgctgaccagtggggccaggagctaccacctcaaggccagctcagaggtggaccggcagcagtggatcaccgccctggagctggccaaggccaaggctgtccgcgtgatgaacactcattcagatgactctggggacgacgacgaggctaccaccccagccgacaagagcgagctgcaccacaccctgaagaatctttccctgaagttagatgacctcagcacgtgcaatgacctcatcgccaagcacggcgctgcactccagcgctccctgacagagctggacggcctcaagatcccatctgagagtggggagaagctgaaggtggtgaatgagcgggccaccctcttccgcatcacatccaatgctatgatcaacgcctgcagggacttcttggaactagcagagatacacagtcggaaatggcagcgggcactgcagtatgagcaggagcagcgcgtgcacttggaggaaaccattgagcagctggcgaagcagcacaacagcctcgagcgggccttccacagtgcccctggccggccggccaacccctccaagagcttcattgagggaagcctcttgactcccaaaggagaggacagtgaggaagatgaagataccgagtactttgatgccatggaagactccacatccttcatcaccgtgatcaccgaggccaaggaagacagcagaaaagctgaaggtagcaccgggacaagttccgtggactggagctcagcagacaatgtactagatggtgcctcgctcgtgcccaagggttcatccaaagtcaagaggcgagtccgcattcccaacaagcccaactacagccttaacctctggagcatcatgaagaactgcatcggccgggagctctccaggatccccatgccggtgaacttcaatgagcccctgtccatgctccagcggctgacagaggacctggagtaccaccacctgctggacaaggcagtgcactgcaccagctcagtggagcagatgtgcctggtggccgccttctctgtgtcctcctactccaccacagtgcaccgcatcgccaagcccttcaaccccatgctgggggagaccttcgagctggaccgcctcgacgacatgggcctgcgctccctctgtgagcaggtgagccaccaccccccctcagctgcgcactacgtgttctccaagcatggctggagcctctggcaggagatcaccatctccagcaagttccggggaaaatacatctccatcatgccgctaggtgccatccacttagaattccaggccagtgggaatcactacgtgtggaggaagagcacctcaactgttcacaacatcatcgtgggcaagctctggatcgaccagtcaggggacatcgagattgtgaaccataagaccaatgaccggtgccagctgaagttcctgccctacagctacttctccaaagaggcagcccggaaggtgacaggagtggtgagtgacagccagggcaaggcccattacgtgctgtccggctcgtgggatgaacaaatggagtgctccaaggtcatgcatagcagtcccagcagccccagctctgacgggaagcagaagacagtgtaccagaccctgtcagccaagctgctgtggaagaagtacccgctgccggagaacgcggagaacatgtactacttctcagagctggccctgaccctcaacgagcacgaggagggcgtagcgccaaccgacagccgcctgcggcccgaccagcggctgatggagaagggccgttgggacgaggccaataccgagaagcagcggctggaggagaagcagcgcctgtcgcggcgccggcggctggaggcctgcgggccgggcagcagctgcagctcggaggaagagaaggaggcggatgcctacacgccactgtggtttgagaagaggctggatccgctgaccggggagatggcctgtgtgtacaagggcggctactgggaggccaaggagaagcaagactggcatatgtgccccaacatcttctgagcgccacccttgcaacaaatacaggcgcctgcacagcctggcccacctgttcattaatgcactcaatttagtactgaatggtctttctcccagcccattcccagcccttcctatttcctttcctattttttttttctccccacactttcttgggactcccaccttggaaggaggaagggctgacctgggttctctccagcccccaggtgcgccgggtcacccgtgccccttcattatggacctgggccctaccggaacccctgccccagttaccacaactcaggccggctggcccgggccatgggctgcgcaaatcaccagcccccaacccagggaggaactggcccctcctagggagcctcttcgacttttttagaaaaatgatctccatttctttccagccatgatgtttagtaaatatttttagtaccgcacttagcagacagctttccaagtgtgctttcttgccacaaaagtgtcctggcaagagccccttatttttaagacatcaggaagccagaccgctttgagttgggagaattttgtagctcaacatatcaagtcctcgatggtatctgagctgcccacacccccacctgccaaggccccacagagcccaaaacagaagggggctgccccagcccagcagagcacagagtttctggagctcccatccacagatgcaggagggggtactgatggtaacccccatgtggatttgagggcagcagtccctggcctcaccctagccagcctgggtggctccctagccccaagaggccaggaagggctggaaggcagggcctgcaggtgctccccgccctgagacccaggccccaaatcagcaataatgaacaaacccttggcccagcctgggctggtgacctgggcaccagagaccttgcatccctcctcatcctaggaggcccctaggggtgccccatctcagtgtcccctgaactctttatttgcctaatttatatatatatatatgagatatataaatatatataaaatagctattttgcttaaatttctacagtatgtaaaagtgaaaaaatgatgaagacgggtgcacctgtctgagtttggccctcatgtgagctgtgcccttccctctcctcatgcccccttccagcggcttctgccaaccatggggggctggaccaccatggccactgacccagcccctcagaatcccacactccaatcctttccatttcagtttagtcctaaaagttcatcacagggtctttctttctactccaggactggttttgtttttatatatataaaaaaaaaaagtgaaaacaccaatgtgtgaaatgccttacaatgcccactggagaggcggggcggggtggggcaggatggccccactggggctcctacagagctgtggaatgtacctctccccaacactgttttgttagcgagcaccttttgaccagtaataaaaaaccttggctttggagttttccactgaaaaaaaaa

SEQ ID NO: 344 - DNA, 2410 bp, Human
gagagcgtgagcgcggagagcggaccgacgcgacacgccgtgcgcctccgcggctgcgctacgaaaacgagtcccggagcggccccgcgcccgccgcacccggccctcgcccgcccgaagacaggcgccaagctgccccgccgtctccccagctagcgcccggccgccgccgcctcgcgggccccgggcggaagggggcggggtcccgattcgccccgcccccgcggagggatacgcggcgccgcggcccaaaacccccgggcgaggcggccggggcgggtgaggcgctccgcctgctgcgcgtctacgcggtccccgcgggccttccgggcccactgcgccgcgcggaccgcctcgggctcggacggccggtgtccccggcgcgccgctcgcccggatcggccgcggcttcggcgcctggggctcggggctccggggaggccgtcgcccgcgatgctgctctccaagttcggctccctggcgcacctctgcgggcccggcggcgtggaccacctcccggtgaagatcctgcagccagccaaggcggacaaggagagcttcgagaaggcgtaccaggtgggcgccgtgctgggtagcggcggcttcggcacggtctacgcgggtagccgcatcgccgacgggctcccggtggctgtgaagcacgtggtgaaggagcgggtgaccgagtggggcagcctgggcggcgcgaccgtgcccctggaggtggtgctgctgcgcaaggtgggcgcggcgggcggcgcgcgcggcgtcatccgcctgctggactggttcgagcggcccgacggcttcctgctggtgctggagcggcccgagccggcgcaggacctcttcgactttatcacggagcgcggcgccctggacgagccgctggcgcgccgcttcttcgcgcaggtgctggccgccgtgcgccactgccacagctgcggggtcgtgcaccgcgacattaaggacgaaaatctgcttgtggacctgcgctccggagagctcaagctcatcgacttcggttcgggtgcgctgctcaaggacacggtctacaccgacttcgacggcacccgagtgtacagccccccggagtggatccgctaccaccgctaccacgggcgctcggccaccgtgtggtcgctgggcgtgcttctctacgatatggtgtgtggggacatccccttcgagcaggacgaggagatcctccgaggccgcctgctcttccggaggagggtctctccagagtgccagcagctgatccggtggtgcctgtccctgcggccctcagagcggccgtcgctggatcagattgcggcccatccctggatgctgggggctgacgggggcgtcccggagagctgtgacctgcggctgtgcaccctcgaccctgatgacgtggccagcaccacgtccagcagcgagagcttgtgaggagctgcacctgactgggagctaggggaccacctgccttggccagacctgggacgcccccagaccctgactttctcctgcgtgggccgtctcctcctgcggaagcagtgacctctgacccctggtgaccttcgctttgagtgccttttgaacgctggtcccgcgggacttggttttctcaagctctgtctgtccaaagacgctccggtcgaggtcccgcctgccctgggtggatacttgaaccccagacgcccctctgtgctgctgtgtccggaggcggccttcccatctgcctgcccacccggagctctttccgccggcgcagggtcccaagcccacctcccgccctcagtcctgcggtgtgcgtctgggcacgtcctgcacacacaatgcaagtcctggcctccgcgcccgcccgcccacgcgagccgtacccgccgccaactctgttatttatggtgtgaccccctggaggtgccctcggcccaccggggctatttattgtttaatttatttgttgaggttatttcctctgagcagtctgcctctcccaagccccaggggacagtggggaggcaggggagggggtggctgtggtccagggaccccaggccctgattcctgtgcctggcgtctgtcccggccccgcctgtcagaagatgaacatgtatagtggctaacttaaggggagtgggtgaccctgacacttccaggcactgtgcccagggtttgggttttaaattattgactttgtacagtctgcttgtgggctctgaaagctggggtggggccagagcctgagcgtttaatttattcagtacctgtgtttgtgtgaatgcggtgtgtgcaggcatcgcagatgggggttctttcagttcaaaagtgagatgtctggagatcatatttttttatacaggtatttcaattaaaatgtttttgtacataaaaaaaaaaaaaaaaaaaaaaaaaaaaaaaa

SEQ ID NO: 345 - DNA, 7158 bp, Human
agggccaggtgcgcaggggagaaacaaggcgccttggagttcaggtgactcccacacgggtcatgctgttgtctcctgatccagccggccctgccaggtgaccatgcctgctctgggcccagctcttctccaggctctctgggccgggtgggtcctcaccctccagccccttccaccaactgcattcactcccaatggcacgtatctgcagcacctggcaagggaccccacctcaggcaccctctacctgggggctaccaacttcctgttccagctgagccctgggctgcagctggaggccacagtgtccaccggccctgtgctagacagcagggactgcctgccacctgtgatgcctgatgagtgcccccaggcccagcctaccaacaacccgaatcagctgctcctggtgagcccaggggccctggtggtatgcgggagcgtgcaccagggggtctgtgaacagcggcgcctggggcagctcgagcagctgctgctgcggccagagcggcctggggacacacaatatgtggctgccaatgatcctgcggtcagcacggtggggctggtagcccagggcttggcaggggagcccctcctgtttgtggggcgaggatacaccagcaggggtgtggggggtggcattccacccatcacaacccgggccctgtggccgcccgacccccaagctgccttctcctatgaggagacagccaagctggcagtgggccgcctctccgagtacagccaccacttcgtgagtgcctttgcacgtggggccagcgcctacttcctgttcctgcggcgggacctgcaggctcagtctagagcttttcgtgcctatgtatctcgagtgtgtctccgggaccagcactactactcctatgtggagttgcctctggcctgcgaaggtggccgctacgggctgatccaggctgcagctgtggccacgtccagggaggtggcgcatggggaggtgctctttgcagctttctcctcggctgcaccccccactgtgggccggcccccatcggcggctgctggggcatctggagcctctgccctctgtgccttccccctggatgaggtggaccggcttgctaatcgcacgcgagatgcctgctacacccgggagggtcgtgctgaggatgggaccgaggtggcctacatcgagtatgatgtcaattctgactgtgcacagctgccagtggacaccctggatgcttatccctgtggctcagaccacacgcccagccccatggccagccgggtcccgctggaagccacaccaattctggagtggccagggattcagctaacagctgtggcagtcaccatggaagatggacacaccatcgctttcctgggtgatagtcaagggcagctgcacagggtctacttgggcccagggagcgatggccacccatactccacacagagcatccagcaggggtctgcagtgagcagagacctcacctttgatgggacctttgagcacctgtatgtcatgacccagagcacacttctgaaggttcctgtggcttcctgtgctcagcacctggactgtgcatcttgccttgctcacagggacccatactgtgggtggtgcgtgctccttggcaggtgcagtcgccgttctgagtgctcgaggggccagggcccagagcagtggctatggagcttccagcctgagctgggctgtctgcaagtggcagccatgagtcctgccaacatcagccgagaggagacgagggaggttttcctatcagtgccagacctgccacccctgtggccaggggagtcatattcctgccactttggggaacatcagagtcctgccctgctgactggttctggtgtgatgtgcccctccccagaccctagtgaggccccagtgctgccgagaggagccgactacgtatccgtgagcgtggagctcagatttggcgctgttgtgatcgccaaaacttccctctctttctatgactgtgtggcggtcactgaactccgcccatctgcgcagtgccaggcctgtgtgagcagccgctgggggtgtaactggtgtgtctggcagcacctgtgcacccacaaggcctcgtgtgatgctgggcccatggttgcaagccatcagagcccgcttgtctccccagaccctcctgcaagaggtggacccagcccctccccacccacagcccccaaagccctggccacccctgctcctgacacccttcccgtggagcctggggctccctccacagccacagcttcggacatctcacctggggctagtccttccctgctcagcccctgggggccatgggcaggttctggctccatatcttcccctggctccacagggtcgcctctccatgaggagccctcccctcccagcccccaaaatggacctggaaccgctgtccctgcccccactgacttcagaccctcagccacacctgaggacctcttggcctccccgctgtcaccctcagaggtagcagcagtgccccctgcagaccctggccccgaggctcttcatcccacagtgcccctggacctgccccctgccactgttcctgccaccactttcccaggggccatgggctccgtgaagcccgccctggactggctcacgagagaaggcggcgagctgcccgaggcggacgagtggacggggggtgacgcacccgccttctccacttccaccctcctctcaggtgatggagactcagcagagcttgagggccctcccgcccccctcatcctcccgtccagcctcgactaccagtatgacacccccgggctctgggagctggaagaggcgaccttgggggcaagctcctgcccctgtgtggagagcgttcagggctccacgttgatgccggtccatgtggagcgggaaatccggctgctaggcaggaacctgcaccttttccaggatggcccaggagacaatgagtgtgtgatggagctggagggcctcgaggtggtggttgaggcccgggtcgagtgtgagccacctccagatacccagtgccatgtcacctgccagcagcaccagctcagctatgaggctctgcagccggagctccgtgtggggctgtttctgcgtcgggccggccgtctgcgtgtggacagtgctgaggggctgcatgtggtactgtatgactgttccgtgggacatggagactgcagccgctgccaaactgccatgccccagtatggctgtgtgtggtgtgagggggagcgtccacgttgtgtgacccgggaggcctgtggtgaggctgaggctgtggccacccagtgcccagcgcccctcatccactcggtggagccactgactgggcctgtagacggaggcacccgtgtcaccatcaggggctccaacctgggccagcatgtgcaggatgtgctgggcatggtcacggtggctggagtgccctgtgctgtggatgcccaggagtacgaggtctccagcagcctcgtgtgcatcaccggggccagtggggaggaggtggccggcgccacagcggtggaggtgccgggaagaggacgtggtgtctcagaacacgactttgcctaccaggatccgaaggtccattccatcttcccggcccgcggccccagagctgggggcacccgtctcaccctgaatggctccaagctcctgactgggcggctggaggacatccgagtggtggttggagaccagccttgtcacttgctgccggagcagcagtcagaacaactgcggtgtgagaccagcccacgccccacgcctgccacgctccctgtggctgtgtggtttggggccacggagcggaggcttcaacgcggacagttcaagtataccttggaccccaacatcacctctgctggccccaccaagagcttcctcagtggaggacgtgagatatgcgtccgtggccagaatctggacgtggtacagacgccaagaatccgggtgaccgtggtctcgagaatgctgcagcccagccaggggcttggacggaggcgtcgcgtggtcccggagacggcatgttcccttggaccctcctgcagtagccagcaatttgaggagccgtgccatgtcaactcctcccagctcatcacgtgccgcacacctgccctcccaggcctgcctgaggacccctgggtccgggtggaatttatccttgacaacctggtctttgactttgcaacactgaaccccacacctttctcctatgaggccgaccccaccctgcagccactcaaccctgaggaccccaccatgccattccggcacaagcctgggagtgtgttctccgtggagggggagaacctggaccttgcaatgtccaaggaggaggtggtggctatgataggggatggcccctgtgtggtgaagacgctgacgcggcaccacctgtactgcgagccccccgtggagcagcccctgccacggcaccatgccctccgagaggcacctgactctttgcctgagttcacggtgcagatggggaacttgcgcttctccctgggtcacgtgcagtatgacggcgagagccctggggcttttcctgtggcagcccaggtgggcttgggggtgggcacctctcttctggctctgggtgtcatcatcattgtcctcatgtacaggaggaagagcaagcaggccctgagggactataagaaggttcagatccagctggagaatctggagagcagtgtgcgggaccgctgcaagaaggaattcacagacctcatgactgagatgaccgatctcaccagtgacctcctgggcagcggcatccccttcctcgactacaaggtgtatgcggagaggatcttcttccctgggcaccgcgagtcgcccttgcaccgggacctgggtgtgcctgagagcagacggcccactgtggagcaagggctggggcagctctctaacctgctcaacagcaagctcttcctcaccaagttcatccacacgctggagagccagcgcaccttttcagctcgggaccgtgcctacgtggcatctctgctcaccgtggcactgcatgggaagcttgagtatttcactgacatcctccgcactctgctcagtgacctggttgcccagtatgtggccaagaaccccaagctgatgctgcgcaggacagagactgtggtggagaagctgctcaccaactggatgtccatctgtctgtataccttcgtgagggactccgtaggggagcctctgtacatgctctttcgagggattaagcaccaagtggataaggggccagtggacagtgtgacaggcaaggccaaatacaccttgaacgacaaccgcctgctcagagaggatgtggagtaccgtcccctgaccttgaatgcactattggctgtggggcctggggcaggagaggcccagggcgtgcccgtgaaggtcctagactgtgacaccatctcccaggcaaaggagaagatgctggaccagctttataaaggagtgcctctcacccagcggccagaccctcgcacccttgatgttgagtggcggtctggggtggccgggcacctcattctttctgacgaggatgtcacttctgaggtccagggtctgtggaggcgcctgaacacactgcagcattacaaggtcccagatggagcaactgtggccctcgtcccctgcctcaccaagcatgtgctccgggaaaaccaggattatgtccctggagagcggaccccaatgctggaggatgtagatgaggggggcatccggccctggcacctggtgaagccaagtgatgagccggagccgcccaggcctcggaggggcagccttcggggcggggagcgtgagcgcgccaaggccatccctgagatctacctgacccgcctgctgtccatgaagggcaccctgcagaagttcgtggatgacctgttccaggtgattctcagcaccagccgccccgtgccgctcgctgtgaagtacttctttgacctgctggatgagcaggcccagcagcatggcatctccgaccaggacaccatccacatctggaagaccaacagcttgcctctgaggttctggatcaatataataaaaaacccgcagtttgtgttcgacgtgcaaacatctgataacatggatgcggtgctccttgtcattgcacagaccttcatggacgcctgcaccctggccgaccacaagctgggccgggactccccgatcaacaaacttctgtatgcacgggacattccccggtacaagcggatggtggaaaggtactatgcagacatcagacagactgtcccagccagcgaccaagagatgaactctgtcctggctgaactgtcctggaactactccggagacctcggggcgcgagtggccctgcatgaactctacaagtacatcaacaagtactatgaccagatcatcactgccctggaggaggatggcacggcccagaagatgcagctgggctatcggctccagcagattgcagctgctgtggaaaacaaggtcacagatctataggaacccaggagccacggcctgctgttgcttcagcctggcctgggcagccctggaagctcggaggagaggccaccttcttaggtgcctgtagtgactgacaagcagagttagtggaaggtgactcccagtctcctggtggctctggcctcggccctgctggatccacctcctagacccggggcctcaaggctcatggggtagtacccagcctgctccccgagtccagcgaccctgtgacaccggtctgcagggagttggggactaagggcttccagagagtggctggaagagactccaggcccctggggagactgtactgttcctgaacactggccttggccacactgggattcggagaggaaggaggagagccccatgcttcctgtctgcctcctccaccatccctgacctcagttgagctgcctctggccttgttgctgctgccacatcctaggtctaagagttgaacgcctctcctaggccactacaaactgacccctcagcagggctggctgccacagggctgccctgcctcataggtagccatggtgagggctatctgctgcaggggggtcttggggagagtggtgactccattgacccagcttttcattaaaggataacacactgcaaaaaaaaaaaaaaaa

SEQ ID NO: 346 - DNA, 1061 bp, Human
cagttagatttggaggttcaacttcaacatggccgaagcaagtagcgccaatctaggcagcggctgtgaggaaaaaaggcatgaggggtcgtcttcggaatctgtgccacccggcactaccatttcgagggtgaagctcctcgacaccatggtggacacttttcttcagaagctggtcgccgccggcagctaccagagattcactgactgctataagtgcttctaccagttgcagcctgcgatgacacagcaaatctatgacaagtttatagctcagttgcagacatctatccgggaggaaatctctgacatcaaagaggaggggaacctagaagctgtcttgaatgccttggataaaattgtggaagaaggcaaagtccgcaaagagccagcctgcaacgggacaccctgcggcgccatgtgcagaaacaggaggccgagaaccagcagctggcagatgccgtcctggcagggcggaggcaggtggaggagctgcagctacaggtccaggcccagcagcaggcctggcaggctctacacagagaacagagggagctggttgctgtgctgagggagcctgagtgaggagaccgccagccccagaagcagagggcagtcaaggtcaagagcctgtggtccagcatgcctggcctgggcgggctacctctgagaacggctgaaatggtgcccagtccatcagcagtgatggaatttgctggaggactaggccagagcaagcctcactgccactgtgcctttggggcacccttggggttggacatacaccccctttagattcctctgtttcttctacctggataattcttggccatgttctctcttctctaggttcaggtcagctctgcccctccgcccccctcctgctggttccccagcccttttccctggccctggcttggagaatctgttttcaatctccactgattgcccccttgctggccagcccaggggcctttaccatgttctctccacatccgtaaataaacttccttcactacactgtaatctgtgagcatgcttcctctgccctggcctctctt

SEQ ID NO: 347 - DNA, 1271 bp, Human
agtggggaagaggacgggtcgagtgctggcttccggcggaaaagcgcgcgagcaagatggccaccaccaagcgcgtcttgtacgtgggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgaggttgccccagataccaaggcatcaaaagccaggggatccagaaaaaacaaagatggccaagagagaaactgggggaaaagccaaaaggttgagagccacaccatctagaagcttcctgcctgcggtgcggcacagaaacaagaagagtcagcaattaccagccagccgaggtcctggaagctgacgtagagctcgtgccgacggcagacctgccggccgtgggagccgtggacgtcatctgcagggacagaaggggcaaggtcttttctggggttcctactgtgtgcagctactatggggtaccagggtgggggatgccctgatgagcacatttgtcaaataaatgaatgacaggaaaccaaaaaaaaaaaaaaaaaa

SEQ ID NO: 348 - DNA, 8738 bp, Human
ctgacaatgctggggagatgaagatagtgtgtggctgcttctggactcaaggaggaggagagagattccgcgagccgacaccatgcgatccaaggcgagggcgaggaagctagccaaaagtgacggtgacgttgtaaataatatgtatgagcccaaccgggacctgctggccagccacagcgcggaggacgaggccgaggacagtgccatgtcgcccatccccgtggggccaccgtcccccttccccaccagcgaggacttcacccccaaggagggctcgccgtacgaggcccctgtctacattcctgaagacattccgatcccagcagacttcgagctccgagagtcctccatcccaggggctggcctgggggtctgggccaagaggaagatggaagccggggagaggctgggcccctgcgtggtggtgccccgggcggcggcaaaggagacagacttcggatgggagcaaatactgacggacgtggaagtgtcgccccaggaaggctgcatcacaaagatctccgaagacctgggcagtgagaagttctgcgtggatgcaaatcaggcgggggctggcagctggctcaagtacatccgtgtggcgtgctcctgcgatgaccagaacctcaccatgtgtcagatcagtgagcagatttactataaagtcattaaggacattgagccaggtgaggagctgctggtgcacgtgaaggaaggcgtctaccccctgggcacagtgccgcccggcctggacgaggagcccacgttccgctgtgacgagtgtgacgaactcttccagtccaagctggacctgcggcgccataagaagtacacgtgtggctcagtgggggctgcgctctacgagggcctggctgaggagctcaagcccgagggccttggcggtggcagcggccaagcccacgagtgcaaggactgcgagcggatgttccccaacaagtacagcctggagcagcacatggtcatccacacggaggagcgcgagtacaaatgcgaccagtgtcccaaggccttcaactggaagtccaacctcatccgccaccagatgtcccacgacagcggcaaacgcttcgaatgtgaaaactgcgtgaaggtgttcacggaccccagcaaccttcagcggcacatccgctcgcagcacgtgggcgctcgggcccacgcctgccccgactgcgggaagaccttcgccacgtcctccggcctcaagcagcacaagcatatccacagcacggtgaagcctttcatatgtgaggtctgccacaagtcctacacgcagttctccaacctgtgccggcacaagcggatgcacgccgactgccgcacgcagatcaagtgcaaggactgtggccagatgttcagcactacctcctccctcaacaagcaccggcgcttctgcgagggcaagaaccattacacgccgggcggcatctttgccccgggcctgcccttgacccccagccccatgatggacaaggcaaaaccctcccccagcctcaatcacgccagcctgggcttcaacgagtactttccctccaggccgcacccggggagcctgcccttctccacggcgcctcccacgttccccgcactcacccccggcttcccgggcatcttccctccatccttgtacccccggccgcctctgctacctcccacatcgctgctcaagagccccctgaaccacacccaggacgccaagctccccagtcccctggggaacccagccctgcccctggtctccgccgtcagcaacagcagccagggcacgacggcagctgcggggcccgaggagaagttcgagagccgcctggaggactcctgtgtggagaagctgaagaccaggagcagcgacatgtcggacggcagtgactttgaggacgtcaacaccaccacggggaccgacctggacacgaccacggggacgggctcggacctggacagcgacgtggacagcgaccctgacaaggacaagggcaagggcaagtccgccgagggccagcccaagtttgggggcggcttggcgcccccgggggccccgaacagcgtggccgaggtgcctgtcttctattcccagcactcattcttcccgccacccgacgagcagctgctgactgcaacgggcgccgccggggactccatcaaggccatcgcatccattgccgagaagtactttggccccggcttcatggggatgcaggagaagaagctgggctcgctcccctaccactcggcgttccccttccagttcctgcccaacttcccccactccctttaccccttcacggaccgagccctcgcccacaacttgctggtcaaggccgagccaaagtcaccccgggacgccctcaaggtgggcggccccagtgccgagtgcccctttgatctcaccaccaagcccaaagacgtgaagcccatcctgcccatgcccaagggcccctcggcccccgcatccggcgaggagcagccgctggacctgagcatcggcagccgggcccgtgccagccaaaacggcggcgggcgggagccccgcaagaaccacgtctatggggaacgcaagctgggcgccggcgaggggctgccccaggtgtgcccggcgcggatgccccagcagcccccgctccactacgccaagccctcgcccttcttcatggaccccatctacagcagggtagaaaagcggaaggtcacagaccccgtgggagccctgaaggagaagtacctgcggccgtccccgctgctcttccacccccagatgtcagccatagagaccatgacagagaagctggagagctttgcagccatgaaggcggactcgggcagctccctgcagcccctcccccaccaccccttcaacttccggtccccacccccaacgctctccgaccccatcctcaggaagggcaaggagcgatacacgtgcaggtactgtgggaagatcttccccagatcagccaatctcaccagacacctgaggacgcacactggggagcagccgtacaggtgtaagtactgcgaccgctccttcagcatctcttcgaacctccagcggcacgtccggaacatccacaacaaggagaagcctttcaagtgccacctgtgcaaccgctgcttcgggcagcagaccaacctggaccggcacctcaagaagcacgagcacgagaacgcaccagtgagccagcaccccggggtcctcacgaaccacctggggaccagcgcgtcctctcccacctcagagtcggacaaccacgcacttttagacgagaaagaagactcttatttctcggaaatcagaaactttattgccaatagtgagatgaaccaagcatcaacgcgaacagagaaacgggcggacatgcagatcgtggacggcagtgcccagtgtccaggcctagccagtgagaagcaggaggacgtggaggaggaggacgacgatgacctggaggaggacgatgaggacagcctggccgggaagtcgcaggatgacaccgtgtcccccgcacccgagccccaggccgcctacgaggatgaggaggatgaggagccagccgcctccctggccgtgggctttgaccacacccgaaggtgtgctgaggaccacgaaggcggtctgttagctttggagccgatgccgacttttgggaaggggctggacctccgcagagcagctgaggaagcatttgaagttaaagatgtgcttaattccaccttagattctgaggctttaaaacatacactgtgcaggcaggctaagaaccaggcatatgcaatgatgctgtccctttccgaagacactcctctccacaccccctcccagggttctctggacgcttggttgaaggtcactggagccacgtcggagtctggagcatttcaccccatcaaccacctctgacgggctgggcagccgggggccggtggccagagcgagggcaccagccacgaaggacggaggcgggcggggccccggagaaccctgtccctgcgtgtggccactcctcagcatcctccccacccaccatggttcattccgacttttccaatggaaactcagatcccaaaagtccctaaagcagtcgtagagtctcaccatctccaaggattggtcttgagaacactgttcagtgacggccatgcaggtggccgtccaaagacagccaacggagctgcctcgcagaatcagccagtgggcaggtggacgctctgctgagacagaagctggtggccactgccgggtgcccgcgtggggtcgcggaagggaatggatagactggtgtgctcaaaagagagagatcactcaaatgatttttataatgaaatgacaagaataacccttttggtaaccgtattgactgcagagtctatttaagcatgtggttttaaaaatagacagtattttttaaaaatcaaaaaatgacttgcaaattgttttttaaaagtaattttgcattgctttgaaatttgagctcatttgcaaacccgagtctgcctgggaacccgcactgtgcctgggtgtattctttatactgtagataatggagaaattttctatctctgtccctatttgtataagccaaggtgatgctgggtgccccgaggcagaacaagaggcgcggggccacacccgtgaaccatgcagacggccgaagaagtcttaggcagggcgccctgggctgcaggcctgcccgaggctgggatgggaagtgtgcctgccctcgtgtgacatggaattggtgtcaggaccgccacgtggccttcagaggaatccacaggtccccacccaagatccctcaattatatggggaagtcgagggcctgtggcttggatccgccatgcagagatgtggccgggcacccatcttccttccctcctctgtccctgcctcggccaccccacgcgggaacccagcgccgtcctctgaaggcagggccttggccacgtcctgggtctcccacctcccacctgaccccagcggctccggtgtcctccacgtggctgccctggggagcaatcccagcggatcgctccgggccaccaagccgcacctgtgcctgagactccggatggacgacacagtcgtcacgtcgctcttcctgcgggttcttggcgagacacagcttgagaacagaagggcgtcgggggaacctgccgcaaggagcagagacagcacagccccccgggcccagccgcctccctctcttgggacgcaacttcttccccactcggatgggctttaaattattcccataggggccaatttcaaataataatttttttccctgatggaatttaccttaatctgtatataacttgtaattttttctaattcatttcttttcttattttatttcctccttaacagtatttttggcattagacattcttattgtgaagaaataatgttaatataagtatctggtgaaggaccaaaaccgtgtgataaggttgtgtgtcgtgtgggagtggggcgattttttatgtgccaaatacccccgtcccccccatgaatcctgctgtccctgctgccgtttaccagacaatcatatgtttttgttaaatttgcgtttcagttacatttgcatttaagacaagtgttctatttatttcttgtattgtttggaagaaaaaatgatgatagagtcccaaaaagaagagaaaaaaaatgcccaagttgccctttaaaaaaaaagagcgtaaatacaaacaggagtggtgcaagccgccttggtgtgggtttgtgtcacgtgtggacatctcctcaggctttgtgtcacgcgtggacatctcctcaggctgtccccagcggtgacgggaggtgtcctggctgctccaggacaaaagacaatcgtctctgtgggtgccgggtggtccaggcttgcactgaagacgtgccacggggaggctcctgcaggaggctcaacccgacggatcacagtgaaagggattcctcccacgccagatctgcacaacgaggcaagacaggacccacctgtgcgtgcgctggggccatggggtggccccgccggggcagcgggggagctgcctgcagaagagccagctggcgtgtcgggaaggatccaggatctgcaaacacaactgctcaggccttctcacgcgtttccacaacatcccctgggtcagacccaccaggtaccccgtaggaatttccagtttcccttgatctagatgggattcttataaaaattcaacctcagacataaacaccccatttctgtaaacccaaattatatggtttcttctgcgaaagagtaaggtgtgtgcttttttttttttgcaatatgaccccgtctctctgaagtgggacattcggacggatggagccctcagcgtgtcttttcagcaggagcagaaccgatgagagccgcccttaccgttggtctccggatcccccagtcccatcccgccgttttcggctgtcttcctaaccgtcctgtcttctcttggcgctctttccttccacctttcccaagagtcctggttgcacgttttaagtcatatattttcgtccccctgaaaatgatggcaagcccagtttctcctgagcattcagacccccaggccccagcacttggcgttttcaggaggccctgttcttagagcccctgacaaaggcagcacttatttcctgggctggtgcgccccaaaacacggccccgacacttagtgtggccccaggccccagcgagcctcgccctcccagttttgctctgcccagcagtgttggtgcccagagatgacaagggccagggagcctggcccgggtgtgagaattcagagattctggcctccagctgtcaccacaccgtaacggggccatgtaactgtgcagcatggacagggatgcgacggggcagctggctgtgtccatggccaggtggccagggtcagggctgcaagccaggggtccagggcccttccgttcagcccaaatgctgccccaatgctaactccttggattgtcaacccccatcccccaaatggaaattccgaaggaggcctcctcgcacctgccctccgctgctcctcagaccccagcccccagcgagccgacgtccccacccgttcctgctctcatccccaggttgggcacgtggggttcctcctctgtgggcctggcagacccttcatgagtgggacccaagatatcactgacttcaacccagaggatcgagcccctgcaccctgcctggggccctggggtgtggagcagtggctggggtgggcgtggtgtggcctgagagactgcccagctggagaggccttcctttacaaggccacgcgtgcagctgtcccatccagaccccgactggccaagacctccacgtccccagagtccagccctggaaattccaagggccctggcgtcctctgccttccccgcttccccatgagcgtctgcaaaacacttgcctgaatacatatcacgtattttagactcgaagcctcaaagcactggattgtggtcccctgccccctctgtcccgtccccctgcccaagtgactgaaacctactgagctatattcactgtgctgtcctagggggagggagagcagagctcgcccctgcactgcagccttgtgggggagggcaaggctctcctcccagccagggacgccaggacatagctgctcctggtcagtggaggtcagccgggtatcaaaagccatgaaactgtgtctctgtagcaatgagtgatactgtgacaaaaccatccttgcattcttcctagaagagttcctctgctccttccattccatttttgtgtttgttttgttcttttctgtcactgatccgtattaccacttttggaaaaaaataaataaataaataaataaaaggcagcttgagtttccaaacgtgtgattcacttgtgaacaaaagtcattctaacaattgccttcagcgtcacgtgcattgccactgcgctttcggcacgagggatgctgagccctggtgtcagagtcgtaatttaaagcgtgtgtgtatatggactttgtcccttaaggtcgatataaagaatcctcgcagaatcacagacctgtgccgcccgccaccttctgccattgttacattacagatttggtttagttttgttttgttttgttttttcttttagaactgtatagtattgaaaaagaaatcaaatgtaaatgtctggttttcatataatgtttaaaaagaccattgagaaggaggctggcgctcgccccatgtcccccttgattgtaaattgcttctgttctgtttataagtaaactgtgcatgactcctgcttagcggtcattatcgtgtctgttggtgaaatttttattaaaaggaaaattctgtagatgcacttattgaatatgtgattaggatctacgtctgagactaggagtcctgaactgctgacgcgaaagaggcgcagttcccaattaatacggaaatcgctgtgggagaagaatgaaataagacgtgaagtgtaggaaatcatgaaaagaacaattttgcaaattgcattctgatgcttgtgatgaacacaaatgtacttgtgtagagacatttccttaagagaaagcctaggagaagccgatttggaggttaatgctgtagaataggactgtataccaaatgtaatctttccaatgctccaatgaatttatacatgagattgatatgcaataaatctgtgtgcttttctaaaaaaaaaaaaaaaaa

SEQ ID NO: 349 - DNA, 3662 bp, Human
gggcgcgggatcaggggccctgggagggcgagcgcggcgaggggcgcatgcagggccccgacgcgccactgctcctgagcgcgagggagctggggcccgggcgccggggctcggcctcctggtaccgccaggagggcggcgcggtgtgcaactggctgcggaagccgcagccgctcgagccacgcaccagtttcccctcggcgcgccgctccgagttccgtccacccaggaggctgccatgggccggccctgcctccgcccagtccgaggagggtcacgcaggcggcagatgccaggcgggcagccccgcccctgcgcgccgcctcagcggcgccttcaagacgctggtcccaggcacccacgcccagggcgcctcggatacccaccccctcggccccccgcacaccccggtcctcgacccctctccgcaggatggtttcccggtcctctggcgaggatcctccaaggcgtctcacatgaaccggctcagaaacgccaaaatctacgtggagagagctgtcaagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatggtgggtctatgtctcaatctccggaatttgccgtggtttgatgaggttgatgccaactccttcttcccacgctgctactgcctgggggctgaggatgacaaaaaagccttcatagaggacttctggctgactgctgcccgcaacgttctcaagctggtggtgaagtctgagtggaagtcataccctattcaggcagtagaggaagaggcctcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcctgctgtggaggtgcctcaatatgtgggcatccggctcctggtagagggcttcaccatcaagaagcccatggcgatgtgtcatcggcggatgggggtccgcccagcagtccctctgctgacccagcgaggctctggggaagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagtatttggggcttgactccattgctgttggagggtcaagagtggatggggcgaggccgtgtaccccagggtccacagcaagagcctgaggccatcagcagctcctccgtgcagcgaggcccagaattcccacctaaggacagacatggggcttcctatttagggactcccccagcatctccgatccaggggtggggagcgtgagccttcactttacagatgaagaaactgagtctgaaagaggaggcatggcttacccaagatcacgtggcagtgagtcgacgcagggacatattgccagaactgccgagcactgggagccccccaaccccagagaacaagccaagctagcagaatgacacctaccgggcataggaacgttaatgccatgagacaggggaaggaattggccttgcctaaacctcagcccttctgcagagggcatgggtctatcccttcttcagcaaggggccaaggtcacctaaaaatgaaacatccaataagccacacccacctgaagaaaagtgtggcactgcttagttgtagtgggttgaactgtggtcccctgaaaagagatgtctacttggaccctgtgaatgtgaccttatgtgggaaaagagtctttgtagctgggtatggtggctcacacctgttatcccagcactttgagaggccaaggcaggagatcgcttgagcccgcaagttcaagaccagtctgggcaacatggtgaaaccgtttctacagaaaattagctgggtgtggtggcacacacctgtagtcctagctactcgggaggcctaggtgggaggattacctgagcctgggaagatcaaaactgtggtgagctgtgatcacgccactgcgctctgagcctgggagacagagtgaaaccctaaatcaaaaaaaaaaaaaaaggtctttgcagatgtaaataaatttaagatcttaaatgaga

SEQ ID NO: 350 - DNA, 2421 bp, Human
aacgtccgcgggcgcggggtgtgtcgggtgtcgacggcggcgctttgcggccggtcgtgcgggtcgggcgcgggcgggcgcggcggcagtggcgcgcacaggtgattgactggccagctgcctgaaggagcgccaggtcctccttgctggcaggtggcgaagcccattggggcggcggtgcagaccgcggcggcggctgcggcggtctggctcgggaggcgttcctggggccaaggccatggccccgcggctgcagctggagaaggcggcctggcgctgggcggagacggtgcggcccgaggaggtgtcgcaggagcacatcgagaccgcttaccgcatctggctggagccctgcattcgcggcgtgtgcagacgaaactgcaaaggaaatccgaattgcttggttggtattggtgagcatatttggttaggagaaatagatgaaaatagttttcataacatcgatgatcccaactgtgagaggagaaaaaagaactcatttgtgggcctgactaaccttggagccacttgttatgtcaacacatttcttcaagtgtggtttctcaacttggagcttcggcaggcactctacttatgtccaagcacttgtagtgactacatgctgggagacggcatccaagaagaaaaagattatgagcctcaaacaatttgtgagcatctccagtacttgtttgccttgttgcaaaacagtaataggcgatacattgatccatcaggatttgttaaagccttgggcctggacactggacaacagcaggatgctcaagaattttcaaagctctttatgtctctattggaagatactttgtctaaacaaaagaatccagatgtgcgcaatattgttcaacagcagttctgtggagaatatgcctatgtaactgtttgcaaccagtgtggcagagagtctaagcttttgtcaaaattttatgagctggagttaaatatccaaggccacaaacagttaacagattgtatctcggaatttttgaaggaagaaaaattagaaggagacaatcgctatttttgcgagaactgtcaaagcaaacagaatgcaacaagaaagattcgacttcttagccttccttgcactctgaacttgcagctaatgcgttttgtctttgacaggcaaactggacataagaaaaagctgaatacctacattggcttctcagaaattttggatatggagccttatgtggaacataaaggtgggtcctacgtgtatgaactcagcgcagtcctcatacacagaggagtgagtgcttattctggccactacatcgcccacgtgaaagatccacagtctggtgaatggtataagtttaatgatgaagacatagaaaagatggaggggaagaaattacaactagggattgaggaagatctagcagaaccttctaagtctcagacacgtaaacccaagtgtggcaaaggaactcattgctctcgaaatgcatatatgttggtttatagactgcaaactcaagaaaagcccaacactactgttcaagttccagcctttcttcaagagctggtagatcgggataattccaaatttgaggagtggtgtattgaaatggctgagatgcgtaagcaaagtgtggataaaggaaaagcaaaacacgaagaggttaaggagctgtaccaaaggttacctgctggagctggtctgtaagatattctgggacagcactgttgccattaagtgccttgtttttttatgttcacaaatgtatatgaagaaactttctcaaacttactctttctaataacccactaaagccagcttaaacactctaaaagtactttgtaaaccaacaataacttgatgtgtagcattccatattatttcattacgttgtactcctaaaaatgggaagctgttaataaattataacatttaggtcagcactctgcatccatgagtattgtagatatttatattttgtgagatattaacttgtttaagaaaaatccgattggattactatggaaaaagcaacttgcctgttctgtttctttgcatactttgtgacctaacagttttaacagacattctattatatgaatacagtttttttgatactattagattaacttgaagtttaataccaaatattatgctaagagtagaaaagctttctgctgacccctgatttcttagaaatatcccacataatccagcttatcccttttctgtatatgtttattcaggtttacctgatgtctcaaaatgaaaccaaattaagcctttttaaaggctgatgtgccatttgtattaagttatctttgtcattttaaagacatgaattccccaagcctaattcctacttaaggaagagagacaatttagtccttactttagaaaataaatacttaagcataattgtaaaaaaaaaa

SEQ ID NO: 351 - DNA, 1278 bp, Human
ccattggcctgtagattcacctcccctgggcagggccccaggacccaggataatatctgtgcctcctgcccagaaccctccaagcagacacaatggtaagaatggtgcctgtcctgctgtctctgctgctgcttctgggtcctgctgtcccccaggagaaccaagatggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacatcgtggagtattacaacgacagtaacgggtctcacgtattgcagggaaggtttggttgtgagatcgagaataacagaagcagcggagcattctggaaatattactatgatggaaaggactacattgaattcaacaaagaaatcccagcctgggtccccttcgacccagcagcccagataaccaagcagaagtgggaggcagaaccagtctacgtgcagcgggccaaggcttacctggaggaggagtgccctgcgactctgcggaaatacctgaaatacagcaaaaatatcctggaccggcaagatcctccctctgtggtggtcaccagccaccaggccccaggagaaaagaagaaactgaagtgcctggcctacgacttctacccagggaaaattgatgtgcactggactcgggccggcgaggtgcaggagcctgagttacggggagatgttcttcacaatggaaatggcacttaccagtcctgggtggtggtggcagtgcccccgcaggacacagccccctactcctgccacgtgcagcacagcagcctggcccagcccctcgtggtgccctgggaggccagctaggaagcaagggttggaggcaatgtgggatctcagacccagtagctgcccttcctgcctgatgtgggagctgaaccacagaaatcacagtcaatggatccacaaggcctgaggagcagtgtggggggacagacaggaggtggatttggagaccgaagactgggatgcctgtcttgagtagacttggacccaaaaaatcatctcaccttgagcccacccccaccccattgtctaatctgtagaagctaataaataatcatccctccttgcctagcataaaaaaaaaaaaaaa

SEQ ID NO: 352 - DNA, 2322 bp, Human
cccgccccctctcttctccctccctcctccttccgtgtgtccctccccgcccggctggaggctgctccggaccgggacgcagagtctgcggacccggcgccgaggcggccacccgagacgcggcgcgcacgctccggcctgcgcccggcccggccatggcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgcccccggaagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacagcccagggagaaggtgagcagtattgatttggagatcgactctctgtcctcactgctggatgacatgaccaagaatgatcctttcaaagcccgggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggctcagaaccaaaaccaggtgcgctcccctggggccccagggcccctgactctgaaggaggtggaggagctggagcagctgacccagcagctaatgcaggacatggagcatcctcagaggcagaatgtggctgtcaacgaactctgcggccgatgccatcaacccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgacaccctggagaagtgtaacacctgcggggagcccatcactgaccgcatgctgagggccacgggcaaggcctatcacccgcactgcttcacctgtgtggtctgcgcccgccccctggagggcacctccttcatcgtggaccaggccaaccggccccactgtgtccccgactaccacaagcagtacgccccgaggtgctccgtctgctctgagcccatcatgcctgagcctggccgagatgagactgtgcgagtggtcgccctggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccagaaaaaaaaaaaaaaaaaaaaa

SEQ ID NO: 353 - DNA, 2626 bp, Human
gcactccgctcctttcctgcgtcaccgctacacatgcgccttgcaaggaagggcgagatttcgggggcagggcggggggcgggcctaggccggggtctcacagcgactgcgcggacgggttcctgagtggaacatggcgacttgcgccgaaatcctgcggagcgagttccccgaaattgacggacaagtcttcgactacgtgaccggcgtcttgcacagcggcagcgcggacttcgagtctgtggatgacctggtggaagctgtaggggaactattgcaagaggtgtccggggacagcaaggatgacgcgggcatcagggccgtgtgccagcgcatgtacaacactctgcgtctggctgagccacaaagccagggaaatagccaggtgctactggacgcccctatccagttgtcaaagataacggagaactacgactgtggaaccaaacttccaggactgctaaagagggaacagtcctcgacagtgaatgcaaagaagttagagaaggccgaggctcgacttaaggcaaagcaggagaagcgctcagagaaggacacgctcaagaccagcaaccctctagtcttagaagaggcatcagccagccaggcaggcagcagaaaggagagtcggttggaatcatctggcaagaacaaatcctatgatgtgcgaattgagaactttgatgtgtcttttggcgatagagtactgctggctggagcggatgtgaacctggcatggggccgccgttacgggctggtggggcggaatgggttggggaagacaacgttactgaagatgctggccacccggagtctgcgggttccagcccacatttccctgctgcacgttgagcaagaggttgctggagatgacactcctgccctgcagagtgtgctggagagtgacagtgtgcgagaggatttgctacggagggagcgggagctcactgcccagattgctgctggcagggcggagggctctgaagctgcagagctggcagaaatctatgccaaactggaggagattgaggctgacaaggcacctgccagggcatcagtcattctcgctgggcttggctttacccctaaaatgcagcagcagcccacccgggagttctcaggtggctggaggatgaggctggccctggcccgggccctctttgctaggccagatcttctgctgttagatgaacctacaaacatgctggatgtcagggccatcctgtggctggagaattacctgcagacgtggccctccaccatcctagtcgtctcccacgaccgcaacttcttgaatgccatcgccacagacatcatccacctgcacagccagcggctagatggttaccggggagactttgagaccttcatcaagagtaagcaggagcggctgctcaaccagcagcgtgaatatgaggcgcagcagcagtatcgccagcacatccaggttttcattgaccggtttcgctacaatgccaacagggcctctcaagtgcagagtaaactcaagatgctggagaagctgcctgagctgaagcctgtggacaaggaatcagaggtcgtaatgaagttccctgatgggtttgagaagttctcgccgccaattctgcagctagatgaggtggatttctactacgatccgaagcacgtcatcttcagtcgcctctctgtgtctgctgatctcgagtctcgcatctgtgtggttggagagaatggggctgggaagtctaccatgctgaagctgcttttgggggacctggcacctgttcggggcatcagacacgctcacaggaatctgaagattggctatttcagccagcaccatgtggagcagctggacctaaacgtcagtgctgtggaactgctggcacgcaagtttcctgggcggcctgaggaggagtaccgtcaccagctgggtcggtatggcatctccggagaactggccatgcgtcctcttgccagcctgtctgggggccagaagagccgagtggcctttgctcagatgactatgccctgccccaacttctacattctggatgaacccacaaaccacctggacatggagaccattgaggctctgggccgtgccctcaacaatttcaggggtggtgtgattctggtgtcccacgatgagcgctttatcaggctggtgtgccgggagttgtgggtatgcgaaggaggcggcgtcacccgtgtggaaggaggatttgaccagtaccgcgccctcctccaggaacagttccgccgcgaaggcttcctctagggccaccaggctgaggactcgcccaggacatggactggtctctcagacccctgggccaccatgtaggccaccactccaggccgtggacttcccccaacttggggacagccttattcccaaatgtctctatccttttgactggagcatcttctgcacaaccttgggagcccatccaagggttggtgaggactggtctcccgggggtgggggtctggggggtaccctctggggttatagattcccccactgccccagctctgactggaccccaagtggctgctatgtaaattaaatctctccccgcgtctcaaaaaaaaaaaaaaaaaaaaaaaaaaaaaaaaaaaaaaaaaaaaaaaaaaaaaa

SEQ ID NO: 354 - DNA, 1567 bp, Human
ggtgcgcggggaggtggagggcgaggggcggggctacctcaggtcccgcccgcggcaggcctgtgggctgcgaggaggagctttgcctagcttgcaggcagcgcagggcagacggcggcaggagaagcaagatgaatgcaggctcagatcctgtggtcatcgtctcggcggcgcggaccatcataggttccttcaatggtgccttagctgctgttcctgtccaggacctgggctccactgtcatcaaagaagtcttgaagagggccactgtggctccggaagatgtgtctgaggtcatctttggacatgtcttggcagcaggctgtgggcagaatcctgttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggctcctcacttggcttacttgagaacaggagtaaagataggtgagatgccactgactgacagtatactctgtgatggtcttacagatgcatttcacaactgtcatatgggtattacagctgaaaatgtagccaaaaaatggcaagtgagtagagaagatcaggacaaggttgcagttctgtcccagaacaggacagagaatgcacagaaagctggccattttgacaaagagattgtaccagttttggtgtcaactagaaaaggtcttattgaagttaaaacagatgagtttcctcgccatgggagcaacatagaagccatgtccaagctaaagccttactttcttactgatggaacgggaacagtcaccccagccaatgcttcaggaataaatgatggtgctgcagctgtcgttcttatgaagaagtcagaagctgataaacgtgggcttacacctttagcacggatagtttcctggtcccaagtgggtgtggagccttccattatgggaataggaccaattccagccataaagcaagctgttacaaaagcaggttggtcactggaagatgttgacatatttgaaatcaatgaagcctttgcagctgtctctgctgcaatagttaaagaacttggattaaacccagagaaggtcaatattgaaggaggggctatagccttgggccaccctcttggagcatctggctgtcgaattcttgtgaccctgttacacacactggagagaatgggcagaagtcgtggtgttgcagccctgtgcattgggggtgggatgggaatagcaatgtgtgttcagagagaatgaattgcttaaactttgaacaacctcaatttctttttaaactaataaagtactaggttgcaatatgtgaaatcagaggaccaaagtacagatggaaaccatttcctacatcacaaaaacccaagtttacagcttgtactttactttaatgtgtaatactcaactcaaggtacaagacaattgcatttaacattgttataaataaaaggaacatcagatcaatcattaaaaaaaaaaaaaaaaaa

SEQ ID NO: 355 - DNA, 1294 bp, Human
tgggctgcggcattcacgtgatctgcacgggcgcagatgtaggcaccggtccgagtgcctgccctctgtccccgcggctgggtctcgtctgctccggttcctgggctcctaattcttggtccagcttcttccaggtctgcgcgtctgttgttcccagcgctctgcgaagcctgaaaaggaggagcaacctgtccagaatccccgcaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaacgttacggtaatactttactttaggcatccctcctgttgctagcagccttttgacctatctgcaatgcagtgttctcagtaggaaatgttcatctgttacatggaaaaaatgttgatggtgcattgtaaaattaaaaaacacaacttgcagaaccaaatatatggcatcagtacatttttgtaaaactacaaagatacttacctagtaatatagtatagaaaacaattctgaaagctgtgtccactaaaagattaacagtggttatctctgggtgattttttctgttcttttttgttcatctgtccatttttctcctaaaaacagatttctttagtcataaaaataataaaatataaagtattggaaaaaaaaaa

SEQ ID NO: 356 - DNA, 3966 bp, Human
aggcgcgggcggagggcgggctgaagcagctgaagcggcggtagcggcggcggctcgggcagaggggcgggagctgaggcgggagcggacaggctggtgggcgagcgagaggcggcggaatggtggactaccacgcggcgaaccagtcgtaccagtacggccccagcagcgcgggcaatggcgctggcggcgggggcagcatgggcgactacatggcccaggaggacgactgggaccgggacctgctgctggacccggcctgggagaagcagcagcgcaagaccttcacggcatggtgcaactcccacctgcggaaggcaggcacacagatcgagaacattgatgaggacttccgagacgggctcaagctcatgctgctcctggaggtcatatcaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtgaggccccagagacctgacccaacacccccgacggcctccaggaggggcctgggcagccccacagtcccattcctccactctgtatctatgcaaagcactctctgcagtcctccggggtgggtgggtgggcagggaggggctggggcaggctctctcctctctctctttgtgggttggccaggaggttcccccgaccaggttggggagacttggggccagcgcttctggtctggtaaatatgtatgatgtgttgtgcttttttaaccaaggaggggccagtggattcccacagcacaaccggtcccttccatgccctgggatgcctcaccacacccaggtctcttcctttgctctgaggtcccttcaaggcctccccaatccaggccaaagccccatgtgccttgtccaggaactgcctgggccatgcgaggggccagcagagggcgccaccaccacctgacggctggggacccacccagcccctctcccctctctgctccagactcacttgccattgccaggagatggccccaacaagcaccccgcttttgcagcagaggagctgagttggcagaccgggcccccctgaaccgcaccccatcccaccagccccggccttgctttgtctggcctcacgtgtctcagattttctaagaaccaaaaaaaaaaaaggaaaaaaaacacaaaacaacaaaaaccaaaaaaaaaaaaaatcacaaaaacaaaaaaactataaaaaagaaagaattaaaaactttcagagaattactatttactttattaacttacggatttattatataaatatatattcacctagcaacatatctctgccgtctctcctgctctcataatgaagacatagccgattctctgcccgggccccttgctgatgctcctccgggtctgcgtcgggcgtgggtctctggggaccctccagaggtggaggtgggctgatggcctggctgcctggtggttgatggttttgctccccctaccttttttttttgagtttattctgattgattttttttcttggtttctggataaaccaccctctggggacaggataataaaacatgtaatatttttaagaaggaaaaaaaaaaaaa

SEQ ID NO: 357 - DNA, 2479 bp, Human
ggcggggctggacgcgcgctccaagatggcggcgaacgtgttcccgttccgcgacgcccgtgccgcaccggacccagtgctggaggccggcccggtggcacacgggccactgccggtaccgctggtgctggacaacgggtcgttccaagtccgcgctggctgggcgtgtcccgggcaggacccaggtcccgagccgcgcctgcagttccgcgcggtgtgcgcccgcggtcgtggcggggcacggggcgcgtcgggcccgcaggtggggaacgctctgggcagcctggagccactgcgctggatgctgcgctcgcccttcgaccgcaacgtgccggtcaacctggagcttcaggagttgctgctggactacagcttccagcacctgggtgtctcctcacagggctgtgttgatcatcccatagttttgacagaagctgtgtgcaacccactgtattcacggcaaatgatgtctgagcttctttttgagtgctacgggattcccaaggttgcctatggaatagacagcctcttcagcttctaccacaataagccaaagaactcgatgtgcagtgggctaatcatttcatctggataccagtgtacgcatgttttacccatcttagaagggagattagatgctaaaaactgcaagcgcatcaatcttggaggaagccaagcagctggttacctccagcgtctcctccagctgaagtaccctgggcacctggcagccatcaccctcagccgcatggaggagattctgcatgagcacagctacatcgctgaggattatgtggaagaattacacaaatggcggtgtcctgattattatgagaataatgtccacaagatgcagctcccattttccagcaagctcctgggcagcactctgacctctgaggagaaacaagaaaggcggcagcagcaattgcggcggctgcaggagctcaatgcccggcggcgggaggagaagctgcagctggatcaggagcgtctggaccgactgctatatgtgcaggaacttctagaggatggccagatggatcagtttcacaaagctctgatagagctgaatatggactccccagaagagctgcagtcctacatccagaagctcagtatagcagtggagcaggctaagcagaaaatcctccaagcggaagtcaacctcgaggtggatgtggtagacagcaagccagagacccctgacctggagcagctggagccgtctttggaagatgtggaaagcatgaatgattttgatcccttgttttcagaggaaacacctggagtggagaagccggtcaccactgttcagcccgtgtttaacttggcagcatatcatcagctatttgttgggacagaaagaattcgagctccagagattattttccagccatctctcataggagaagaacaggctgggattgcagagactcttcagtacattctggacaggtacccaaaggacattcaggaaatgctggttcagaacgttttcctcactggcggcaacacgatgtatcctggcatgaaagccagaatggagaaggaactgttggagatgagacccttccggtcttcttttcaggttcaacttgcctcgaaccctgtgctggatgcctggtacggtgctcgtgactgggccttgaaccacctagatgataatgaagtttggatcaccaggaaagagtatgaagaaaagggaggagagtacctcaaggagcactgtgcttccaacatctatgtccccatccgcctgccgaagcaggcctcccgctcctcagatgcccaggcatccagcaagggctccgctgctggtggaggtggtgctggtgagcaggcatagcagaggccctccagagagactgccctgcacgccatgccttgggccacgttggcagtgtgacaggactgtgattgtgctagatgtacctgcccaagtctgctggtcacatttggcagcaaaatggatttctcctggggagaacaaagttaagggacactgagacctgcccttcagaattcggttcacttgggggcttctgtggtagagactaactggccttctgatgtctttgttcaactgtggccagctgtggcatcagcttcctggagcagtaaatgaagacagagtggaggacacaaatgtacaaaatgcacaagactgatttcttaccacattttagtctttcttgttttaaaaaaaattctttaaaatttatcttgtccgtgtagatactttattcttctggatgtattcagaaattgcatgaatgcccagtgaggggaggtctttcatgcatataaaaaggtaatgtttattgccgggcacagtggcacgtgcctgttaaggcccagctttgtgggaggctaaggcaggaggatcgctggagcttaggagttcgaggctatcgtgtgctgtgatcgcacctgtgaataaccactgcactccagcctgggcaacataggaagacat

SEQ ID NO: 358 - DNA, 2378 bp, Human
gctgcatacacttatcacaggtttcggctttgtaaattaattcatctgcaaatagtgcactgtctccaggtacaaattcgatgctggagcactggtttcttaaggatttaagtttaaagtcaaaggcttcctgccctaggtgttacaaataagtagtgtcgttttctttttttgctctgagtttgttcatccaatcgtatccgagtatgcaaataaactttagcccgtgcagataaaaaaggaacaaataaagccaagtgctctatcagaaccaaattgctgagccagtcacctgtgttccaggagccgaatcagaaatgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatatagacaaagtagccttcacaggatcaacagaggttggcaagttgatcaaagaagctgccgggaaaagcaatctgaagagggtgaccctggagcttggaggaaagagcccttgcattgtgttagctgatgccgacttggacaatgctgttgaatttgcacaccatggggtattctaccaccagggccagtgttgtatagccgcatccaggatttttgtggaagaatcaatttatgatgagtttgttcgaaggagtgttgagcgggctaagaagtatatccttggaaatcctctgaccccaggagtcactcaaggccctcagattgacaaggaacaatatgataaaatacttgacctcattgagagtgggaagaaagaaggggccaaactggaatgtggaggaggcccgtgggggaataaaggctactttgtccagcccacagtgttctctaatgttacagatgagatgcgcattgccaaagaggagatttttggaccagtgcagcaaatcatgaagtttaaatctttagatgacgtgatcaaaagagcaaacaatactttctatggcttatcagcaggagtgtttaccaaagacattgataaagccataacaatctcctctgctctgcaggcaggaacagtgtgggtgaattgctatggcgtggtaagtgcccagtgcccctttggtggattcaagatgtctggaaatggaagagaactgggagagtacggtttccatgaatatacagaggtcaaaacagtcacagtgaaaatctctcagaagaactcataaagaaaatacaagagtggagagaagctcttcaatagctaagcatctccttacagtcactaatatagtagattttaaagacaaaatttttcttttcttgatttttttaaacataagctaaatcatattagtattaatactacccatagaaaacttgacatgtagcttcttctgaaagaattatttgccttctgaaatgtgacccccaagtcctatcctaaataaaaaaagacaaattcggatgtatgatctctctagctttgtcatagttatgtgattttcctttgtagctacttttgcaggataataattttatagaaaaggaacagttgcatttagcttctttcccttagtgactcttgaagtacttaacatacacgttaactgcagagtaaattgctctgttcccagtagttataaagtccttggactgttttgaaaagtttcctaggatgtcatgtctgcttgtcaaaagaaataatccctgtaatatttagctgtaaactgaatataaagcttaataaaaacaaccttgcatgattcttgttaaaaaaaaaa

SEQ ID NO: 359 - DNA, 5389 bp, Human
aattcctacttcctgaaactgaagccgtttatgagaaacagtgtgtttcagagaggctgtaccagaattaactctgctcagagttagatttgctggtcttaaagtacttttcctctttaagataaaagaagttcttctaaatcaggaatggattgaaatctaatgaaccgaaactttgggtaattgatcaccctagacccagggacacccaattcatcgtaatcatcatgaataatcaaaaagtggtagctgtgctactgcaagagtgcaagcaagtgctggatcagctcttgttggaagcgccagatgtgtcggaagaggacaagagcgaggaccagcgctgcagagctttactccccagcgagttaaggaccctgatccaggaggcaaaggaaatgaagtggcccttcgtgcctgaaaagtggcagtacaaacaagccgtgggcccagaggacaaaacaaacctgaaggatgtgattggcgccgggttgcagcagttactggcgtccctgagggcctccatcctcgctcgggactgtgcggctgcggcggctattgtgttcttggtggaccggttcctgtatgggctcgacgtctctggaaaacttctgcaggtcgccaaaggtctccacaagttgcagccagccacgccaattgccccgcaggtggttattcgccaagcccgaatctccgtgaactcaggaaaacttttaaaagcagagtatattctgagcagtctaataagcaacaatggagcaacgggtacctggctgtacagaaatgaaagtgacaaggtcctggtgcagtcggtctgtatacagatcagagggcagattctgcaaaagctggggatgtggtacgaagcagcagagttaatatgggcctccattgtaggatatttggcacttcctcagccggataaaaagggcctctccacgtcgctaggtatactggcagacatctttgtttccatgagcaagaacgattatgaaaagtttaaaaacaatccacaaattaatttgagcctgctgaaggagtttgaccaccatttgctgtccgctgcagaagcctgcaagctggcagctgccttcagtgcctatacgccgctcttcgtgctcacagctgtgaatatccgtggcacgtgtttattgtcctacagtagttcaaatgactgtcctccagaattgaaaaacttacatctgtgtgaagccaaagaggcctttgagattggcctcctcaccaagagagatgatgagcctgttactggaaaacaggagcttcacagctttgtcaaagctgctttcggtctcaccacagtgcacagaaggctccatggggagacagggacggtccatgcagcaagtcagctctgtaaggaagcaatggggaagctgtacaatttcagcacttcctccagaagtcaggacagagaagctctgtctcaagaagttatgtctgtgattgcccaggtgaaggaacatttacaagttcaaagcttctcaaatgtagatgacagatcttatgttcccgagagtttcgagtgcaggttggataaacttatcttgcatgggcaaggggatttccaaaaaatccttgacacctattcacagcaccatacttcggtgtgtgaagtatttgaaagtgattgtggaaacaacaaaaatgaacagaaagatgcaaaaacaggagtctgcatcactgctctaaaaacagaaataaaaaacatagatactgtgagtactactcaagaaaagccacattgtcaaagagacacaggaatatcttcctccctaatgggtaagaatgttcagagggaactcagaaggggaggaaggagaaactggacccattctgatgcatttcgagtctccttggatcaagatgtggagactgagactgagccatcggactacagcaatggtgagggagctgttttcaacaagtctctgagtggcagccagacttccagtgcttggagcaacttatcagggtttagttcctctgcaagctgggaggaagtgaattatcacgttgacgacaggtcagccagaaaagagcctggcaaagaacatctggtggacactcagtgttccactgccttgtctgaggagctagagaatgacagggaaggcagagctatgcattcattgcattcacagcttcatgatctctctcttcaggaacccaacaatgacaatttggagccttctcaaaatcagccacagcaacagatgcccttgacacccttctcgcctcataataccccaggcattttcttggcccctggtgcagggcttctagaaggagctccagaaggtatccaggaagtcagaaatatgggacccagaaatacttctgctcactccagaccctcatatcgttctgcttcttggtcttctgattctggtaggcccaagaatatgggcacacatccttcagtccaaaaagaagaagcctttgaaataattgttgagtttccagaaaccaactgcgatgtcaaagacaggcaggggaaagagcagggagaagaaattagtgaaagaggcgcaggccctacatttaaagctagtccctcctgggttgacccagaaggagaaacagcagaaagcactgaagatgcacccttagactttcacagggtcctgcacaattctctgggaaacatttccatgctgccatgtagctccttcacccctaattggcctgttcaaaatcctgactccagaaaaagtggtggcccagtcgcagagcagggcatcgaccctgatgcctccacagtggatgaggaggggcaactgctcgacagcatggatgttccctgcacaaatgggcacggctctcatagactgtgcattctgagacagccgcctggtcagagggcggagacccccaattcctctgtaagcggtaacatcctcttccctgtcctcagcgaggactgcactaccacagaggaaggaaatcagcctggaaacatgctaaactgcagccagaactccagctcatcctcagtgtggtggctgaaatcacctgcattttccagtggttcttctgagggggacagcccttggtcctatctgaattccagtgggagttcttgggtttcattgccgggaaagatgaggaaagagatccttgaggctcgcaccttgcaacctgatgactttgaaaagctgttggcaggagtgaggcatgattggctgtttcagagactagagaatacgggggtttttaagcccagtcaactccaccgagcacatagtgctcttttgttaaaatattcaaaaaaatctgaactgtggacggcccaggaaactattgtctatttgggggactacttgactgtgaagaaaaaaggcagacaaagaaatgctttttgggttcatcatcttcatcaagaagaaattctggggaggtatgttgggaaagactataaggagcagaaggggctctggcaccacttcactgatgtggagcgacagatgaccgcacagcactatgtgacagaatttaacaagagactctatgaacaaaacattcccacccagatattctacatcccatccacaatactactgattttagaggacaagacaataaagggatgtatcagtgtggagccttacatactgggagaatttgtaaaattgtcaaataacacgaaagtggtgaaaacagaatacaaagccacagaatatggcttggcctatggccatttttcttatgagttttctaatcatagagatgttgtggtcgatttacaaggttgggtaaccggtaatggaaaaggactcatctacctcacagatccccagattcactccgttgatcagaaagttttcactaccaattttggaaagagaggaattttttacttctttaataaccagcatgtggaatgtaatgaaatctgccatcgtctttctttgactagaccttcaatggagaaaccatgcacatagaatacggcacagtctggtcctttggggcttgggcagggccgtgacacaggttctggccaatgatttgcaagaggaattgatcagtatcactttaagtcctgcatttaattggcagcacaagatcctgcagagcctctttccctctgccacagttatcaagaatgggtcaggagaccgctgcttctgggcataagtcctgcaaggaaagcaacatggaaaacagccccaactcacccatgagggatgaaaagcactcttgagaaaggcatgtgttgtttaagccattgagattttagagctttttgtcactatctgtcaagactgatactactggggcttttcctattgatttgggagttctttacatattaaaaaaatgtgagcctttgtgatacgaattcaatttgttttcctgtcttttgacatttgactttgcataaaagtttatctgtgcataattttatatgtagttgaattcatcaatcttttattttgtatggctttttggttatgtataatacttagatcctccttatactctgagtttctttctttttaattctcctgtatttccttctagtataattaaatctgtaaaaagtaagatggaagagtggtacagttttctttatccagtctgtccttgatgggcatttaggtagactggataaagaaaatgtggtacatatacaccatggaacactatgtgtattaatccactctcacactgctatgaagagatacctgagactgggtaatttagaaagaaaagaggtttaattaactcacagttccacatggctggggagacctcaggaaacttacaatcatggcagaaggcacctcttcatagggtagcaggagagagaatgagtgccagcaggggaaatgccagatgcttataaagccatcagatcttgtgagaattcattcactctcacgagaacagcatgggaaaaactgcctcaattacctcctaccaggtccttcccatgacacatgggaattatgggactacaattcgagatgagatttgggtggggacacaaagccaaaccatatcacaatgtaaccataaaaaagaatgagatcatgtcctttgcagggacatggatagagctggaggccattatttttagcaaactaatgcaagaacagaaaactaaataccacttgttctcacttataggtgagagctaagtgatgagagtaggtggacacatagagggaacaacacacaccagggcttatcagagggtggacagtgggaggagggagaggatcaggaaaaataactaatgggtactaggctgaatacctgggtgatgaagtaattcgcacaacaaacccccatgacacaaacctgcacatgtacccctgaacttaaaataaaagtaaaaaaaaaaaaaaaaaaaaaaaaaaaaaaa

SEQ ID NO: 360 - DNA, 3617 bp, Human
cagtctcctgaatatttacgcgttgctgaatctcctgtggacaaaccaccaataggccaggactgtcctgtggacagacggggtgagcctcttcttgtgtctggagattctgaaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtttgcaatggtctggagcagccaaggaagcagcagcgctctgatctcaatggacctgttgacaataacaacattccagagacaaagaaggtggcatcatttccaagttttgtggctgttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaagaattctgagggggatgcccagacgctgacggaagtggacctcttcatttccacccagaggatcaaggttttaaatgcagacacgcaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaagggcctgaagaaccagacacaggtgaagctcaacattgtcagctgtcccccggtcaccacggtccttatcaagcggccagacctcaagtaccagctgggcttcagcgtgcagaatggaattatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgtaaataaaggatgatggccacaacatgaaaactccatatttatttagatgctattattactgtttggacttttattttggcaggcttttttccagactctagggttttccaatgtgactaatgaccacacctgcctctcccgtcgtctcttctgggcaccctcccacccggctgcatacccgggcagggctcccacagagacaaggagggcacaggtgtctgccccctctttaaaatcgatctacacacatccacgcacatgcgaccccgaggaaacgaaacccactctagaaaacgcgaccttggccgcacctaaagcagccagccgtgagtgcagaccccttggccagcgtggcgcagtggccctgagcagtagtggcatgtgtgtagatcaagtcggatctagtccagctcggttcattagcgatccatgtaatctgacgtcatcttgtctcgaagtctctttttttggcccaggccttgaagaatacactgtgacttaagaagccttaccacgcagtaactaaagctttaggatgactgtattcgaggagtgccgtgtgttgcatgcagctacccgtaggaagacttcgcgcatatcactaataaacctgaagtcgtgatgaaaaaaaaaaaaaaaaaa

SEQ ID NO: 361 - DNA, 2919 bp, Human
ggccctccccgcccgggccctcggacccggagcagccccgcccgcccagcgcccacctgcggggccgcagccgccgccctccagccagaccgcgcaggaagcggaggaggcgccccgggccggaccgcgctgccgcaggagcgaagcggctgcaggacaggacaggacccggcgctggaagctgcaccgccagcgcgccgcccctccgtccctccgccccgcggcgcaggaccccacagccgcccagcatggcccagcggcactcagacagctccttggaggagaagctcctgggacaccgcttccactcggagctccggctcgatgccggggggaacccagcctccgggctcccaatggtccgtggctccccgcgtgttagagacgatgccgccttccagccccaggtcccggcacccccacagcctcggcccccggggcacgaggagccatggcccatcgtcctgagcacagagagcccggcggccctcaagctgggcacccaacagctgatccctaagagcctggctgtggccagcaaggcaaagaccccagcccgccaccagagcttcggggcggctgtacttagcagggaggccgcccggcgggaccctaagctcctcccagcccccagcttctccctggatgacatggacgtggacaaggaccccgggggcatgctgaggcggaacctgcggaaccaatcctaccgggcggccatgaagggcctggggaagccaggtggccagggagatgccatccagctaagccctaagctccaggctctggctgaggaacccagccagcctcatactcggagcccggccaaaaacaagaagacgctggggaggaaacgtgggcacaagggttccttcaaggacgacccccagctctaccaggagatccaggagcggggcctgaacaccagccaggagtctgatgacgacatcctcgatgagtcctccagccccgagggaacccagaaggtggacgccaccattgtggtcaagagctaccggcccgcccaggtcacctggagccagctcccagaggtggtggaattgggcatcctggaccagctctccactgaggagcggaaaaggcaggaggccatgttcgagatcctcacgtcggagttctcctaccagcacagcctgagcatcctggtggaggagttcctgcagtccaaggagctgcgggcgaccgtgacccagatggagcaccaccacctcttctccaacatcctggatgtcctgggtgccagtcagaggttcttcgaggacctggagcagcggcacaaggcccaggtgctggtcgaggacatcagtgacatcctggaggagcacgctgagaagcacttccacccctacatcgcctactgctccaacgaggtctaccaacagcgcacgctgcagaagctgataagcagcaacgccgccttccgagaggccctgagagagattgagaggcggccggcgtgcgggggcctgcccatgctctccttcctgatcctccccatgcagcgggtgacccggctgcccctcctgatggatacgctctgcctcaagacccagggccactccgaaaggtacaaggctgccagccgtgcactgaaggccatcagcaagctggtgaggcagtgcaacgagggggcccacaggatggagcgcatggagcagatgtacacgctgcacacacagctggacttcagcaaggtcaagtccctcccactgatctccgcctcccggtggctgctgaagcgcggagagctgttcttagtggaagaaaccggactttttcgaaaaattgccagccggccaacgtgctaccttttcctgttcaacgatgtcctggttgtgaccaagaagaagagcgaggagagctacatggtccaggactacgcccagatgaaccacatccaggtggagaagatagagccgtctgagctccctctgcccgggggcggcaaccgtagctcctccgtgccccaccccttccaggtgaccctgcttcgcaacagcgagggccgccaggagcagctcctgctctcctcggactccgcgagtgaccgggcacggtggatcgtggcgctcacacacagtgagagacagtggcagggcctctccagcaaaggagacctgccccaggtggagatcaccaaggccttcttcgcgaagcaagcagacgaggtcacactgcagcaggcggacgtggtcctggttctgcagcaggaggatgggtggctctatggcgagaggctccgggacggagagacgggatggttccccgaggactttgcccgcttcatcaccagccgtgtggccgtggagggcaatgtccgcaggatggagcgtctgcgggtggagacggacgtgtagccctggcgaggccagccggcggcagcacagcctgtccccaatcagcaagtggtcgtgcctggctctagagagcgtggggagctggtctcaaggacccagcatggttccctggggcttcccaagagcctgtggctgtggtgccgggctccagacacttcacggaaggaagatcacatgtccccagagaggcacccccaggcaagctcgagggggccacaccgtgtcccagggagcccagcctattcccgttggctggctgggcccctctcagctgctgggccccacctccccactgcacccagggggcaactccacctggactgatgggcacaggaggcaccaatagcgattattgggggcaatgcgaggtctcctcctatgcccttcctacccctgagtgggacaagaagggccctgagtgcccaggagtgccccacgttctgagaaggggccggccggagggaggggacccggcagggagatttcggttttgaggtttctaaatacattaaagttatttcttaagaaaaaaaaaaaaaaa

SEQ ID NO: 362 - DNA, 2064 bp, Human
atctccactcccctcccaccaggcacgaggacatccccatccccacgccactcgcaccgggtccgcggggaaccccctatctctaccttccccgacgcggctcccacaagacccccatctctgcgccgggcccctccacgtgcggggtctcaggtttgaggtggtcccctccaagtttaaagagaagctggacaaagcctccttcgctactccgtatgggtacgccatggagaccgccaagcagaaggccctggaggtggccaaccggctgtaccagaaagacctgcgggcccccgacgtggtcattggagcggacacgatcgtgacagtcggggggctgattctggagaagccggtggacaagcaggacgcctacaggatgctgtcccggttgagtgggagagaacacagcgtgttcacaggtgtcgcgatcgtccactgctccagcaaagaccatcagctggacaccagggtctcggaattctacgaggaaacgaaggtgaagttctcggagctgtccgaggagctgctctgggaatacgtccacagcggggagcccatggacaaagctggcggctacgggatccaggccctgggcggcatgctggtggagtccgtacacggggactttctgaacgtggtgggattcccgctgaaccacttctgcaagcagctggtgaagctctactacccgccccgtccggaggacctgcggcggagtgtcaagcacgactccatcccggccgcggacaccttcgaagacctcagtgacgtggaggggggcggctcggagcccactcagagggacgcgggcagccgcgatgagaaggccgaggcgggagaggcgggacaggccacggcagaggctgagtgtcacaggactcgggagaccctgcctccgttcccgacacgcctcctggagctgattgagggctttatgctatccaagggcctgctcaccgcttgcaaactgaaggtgttcgatttgttaaaagatgaagcaccccagaaggctgcggatattgccagcaaagtggacgcctctgcgtgtggaatggagaggcttctggacatctgtgctgccatggggctcctggagaagacagagcaaggttacagtaacacagagacagcgaacgtctacctggcatcggatggcgaatactctctgcacggcttcatcatgcacaataatgacctcacatggaacctctttacatacctggagtttgccatccgagagggaacaaaccagcaccacagggcgttggggaagaaggcggaagatctgttccaggatgcgtactaccagagcccggagacgcggctgaggttcatgcgggccatgcacggcatgacgaagctgactgcgtgccaggtggccacggccttcaatctgtcccgcttctcctccgcctgcgacgtgggaggctgcacgggtgcactggcccgagagctggcccgtgagtaccctcgtatgcaggtgactgtgtttgacctcccagacattatcgagctggccgcccacttccaaccccccggaccgcaggcagtgcagatccacttcgcagcaggtgactttttcagggaccccctccccagcgctgagctgtacgtcctgtgccggatcctgcatgactggccagacgacaaagtccacaagttactcagcagggtcgccgagagctgcaagccaggggccggcctgctgctggtggagacgctcctggatgaggagaagagggtggcgcagcgcgccctgatgcagtcactgaacatgctggtgcagactgaaggcaaggagcggagcctgggcgagtatcagtgcttgctggagctgcacggcttccaccaggtgcaggtggtgcacttggggggtgtcctggatgccatcttggccaccaaagtggccccctgaagcccaggcagcatgttcattatagggatgtcctcccccaggctgcaggtggaccgcccggtccccaagtaccataggacagtcacataggagcgtgtagtcgtgactgaataaagaaagcaaaagcctgaaaaaaaaaaaaaaaa

SEQ ID NO: 363 - DNA, 3981 bp, Human
agtgtcggagccgcgccgagcctggtggcccaggtgccccgcccgcgtcagccctgctccagccccgcgctagcccagcgcccctcgccccgggccgtccggaccgcgcccccgcccagggccttgcgcacgccggggcccaggccgagggccgcagcgccggggccggcgatgagcgcgaggagccggcatgagcgcagacagcagccctctcgtgggcagcacgcccaccggttatgggaccctgacgatagggacatcaatagatcccctcagctcctcagtttcatccgtgaggctcagcggctactgtggcagtccatggagggtcatcggctatcacgtcgtggtctggatgatggctgggatccctttgctgctcttccgttggaagcccctgtggggggtgcggctgcggctccggccctgcaacctggcccacgccgaaacactcgttatcgaaataagagacaaagaggatagttcctggcagctcttcactgtccaggtgcagactgaggccatcggcgagggcagcctggagccgtccccacagtcccaggcagaggatggccggagccaggcggcagttggggcggtaccagagggtgcctggaaggatacggcccagctccacaagagcgaggaggcgaagcgggtgctgcggtattacctcttccagggccagcgctatatctggatcgagacccagcaagccttctaccaggtcagcctcctggaccatggccgctcttgtgacgacgtccaccgctcccgccatggcctcagcctccaggaccaaatggtgaggaaggccatttacggccccaacgtgatcagcataccggtcaagtcctacccccagctgctggtggacgaggcactgaacccctactatgggttccaggccttcagcatcgcgctgtggctggctgaccactactactggtacgccctgtgcatcttcctcatttcctccatctccatctgcctgtcgctgtacaagaccagaaagcaaagccagactctaagggacatggtcaagttgtccatgcgggtgtgcgtgtgccggccagggggagaggaagagtgggtggactccagtgagctagtgcccggagactgcctggtgctgccccaggagggtgggctgatgccctgtgatgccgccctggtggccggcgagtgcatggtgaatgagagctctctgacaggagagagcattccagtgctgaagacggcactgccggaggggctggggccctactgtgcagagacacaccggcggcacacactcttctgcgggaccctcatcttgcaggcccgggcctatgtgggaccgcacgtcctggcagtggtgacccgcacagggttctgcacggcaaaagggggcctggtgagctccatcttgcacccccggcccatcaacttcaagttctataaacacagcatgaagtttgtggctgccctctctgtcctggctctcctcggcaccatctacagcatcttcatcctctaccgaaaccgggtgcctctgaatgagattgtaatccgggctctcgacctggtgaccgtggtggtgccacctgccctgcctgctgccatgactgtgtgcacgctctacgcccagagccgactgcggagacagggcattttctgcatccacccactgcgcatcaacctggggggcaagctgcagctggtgtgtttcgacaagacgggcaccctcactgaggacggcttagacgtgatgggggtggtgcccctgaaggggcaggcattcctgcccctggtcccagagcctcgccgcctgcctgtggggcccctgctccgagcactggccacctgccatgccctcagccggctccaggacacccccgtgggcgaccccatggacttgaagatggtggagtctactggctgggtcctggaggaagagccggctgcagactcagcatttgggacccaggtcttggcagtgatgagacccccactttgggagccccagctgcaggcaatggaggagcccccggtgccagtcagcgtcctccaccgcttccccttctcttcggctctgcagcgcatgagtgtggtggtggcgtggccaggggccactcagcccgaggcctacgtcaaaggctccccggagctggtggcagggctctgcaaccccgagacagtgcccaccgacttcgcccagatgctgcagagctatacagctgctggctaccgtgtcgtggccctggccagcaagccactgcccactgtgcccagcctggaggcagcccagcaactgacgagggacactgtggaaggagacctgagcctcctggggctgctggtcatgaggaacctactgaagccgcagacaacgccagttatccaggctctgcgaaggacccgcatccgcgccgtcatggtgacaggggacaacctgcagacagcggtgactgtggcccggggctgtggcatggtggccccccaggagcatctgatcatcgtccacgccacccaccctgagcggggtcagcctgcctctctcgagttcctgccgatggagtcccccacagccgtgaatggcgttaaggatcctgaccaggctgcaagctacaccgtggagccagacccccgatccaggcacctggccctcagcgggcccacctttggtatcattgtgaagcacttccccaagctgctgcccaaggtcctggtccagggcactgtctttgcccgcatggcccctgagcagaagacagagctggtgtgcgagctacagaagcttcagtactgcgtgggcatgtgcggagacggcgccaatgactgtggggccctgaaggcggctgatgtcggcatctcgctgtcccaggcagaagcctcagtggtctcacccttcacctcgagcatggccagtattgagtgcgtgcccatggtcatcagggaggggcgctgttcccttgacacttcgttcagcgtcttcaagtacatggctctgtacagcctgacccagttcatctccgtcctgatcctctacacgatcaacaccaacctgggtgacctgcagttcctggccatcgacctggtcatcaccaccacagtggcagtgctcatgagccgcacggggccagcgctggtcctgggacgggtgcggccaccgggggcgctgctcagcgtgcccgtgctcagcagcctgctgctgcagatggtcctggtgaccggcgtgcagctagggggctacttcctgaccctggcccagccatggttcgtgcctctgaacaggacagtggccgcaccagacaacctgcccaactacgagaacaccgtggtcttctctctgtccagcttccagtacctcatcctggctgcagccgtgtccaagggggcgcccttccgccggccgctctacaccaatgtgcccttcctggtggccctggcgctcctgagctccgtcctggtgggccttgtcctggtccccggcctcctgcaggggccgctggcgctgaggaacatcactgacaccggcttcaagctgctgctgctgggtctggtcaccctcaacttcgtgggggccttcatgctggagagcgtgctagaccagtgcctccccgcctgcctgcgccgcctccggcccaagcgggcctccaagaagcgcttcaagcagctggaacgagagctggccgagcagccctggccgccgctgcccgccggccccctgaggtagtgcaggcccacgggcaccccagacactggaactccctgcctctgagccaccaactggacccctctccagcaacaccaccgccaccacctcccacatccctgaggttggcgactgtctacactcctcccccgagaccacccccaccctggggaagcgttgactactgtcccctaccttggaccatcccgcgtaggggtggcagcccccagctcccctcagtgctgctgtcagtgtagcaaataaagtcatgatattttcctggc

SEQ ID NO: 364 - DNA, 5518 bp, Human
gtcgccatcttgccccttcagaggcaccgcaaacaaacccaattcctggtgtcccctagtcttggcggaggagccttttagatgagccccgaaaggccgggcagggaggacaagctctttggggctaccaaacagaagcagcaatgcctgttgtgtggccaacccttctggatctcagcagggatgaatgcaaaagaattcttcgaaaattggaattggaggcatatgctggagttatcagtgcacttcgggcacagggggatctcaccaaggaaaagaaagatcttcttggagaactatcaaaagttcttagcatctcaacagaacgccaccgtgctgaagttcggagagcagtaaacgatgaacggttaacaacaattgcacataatatgtctggacctaatagctcttcagaatggtccattgaaggtcgtcgattggtaccactgatgccccggctcgttccccaaaccgcctttactgtaacagctaatgctgttgctaatgcagctatccagcataatgcatctcttccagtgcctgcagaaacaggaagcaaggaagtggtttgctattcctacacaagtaccacgtcaaccccaacctctacccctgttccaagtggcagcatagcaacggttaagtctccaagacctgccagtcctgcctccaatgtagttgtcttgccaagtggaagtactgtttatgtcaaaagtgtaagctgttcagatgaagatgaaaaacccagaaaacgaaggcgaacaaactcttccagctcctctcctgttgttctaaaggaagttccaaaggccgttgttccagtctcaaagacgatcactgtgcctgtgagtggtagtcccaagatgagcaacatcatgcagagcattgccaactccttaccaccccacatgtctcctgtaaaaataaccttcactaaaccatcaacacagacaacaaacacaacaacacagaaggttattatagtcaccacatcaccaagctcaaccttcgtgcccaacattctctccaaatcccataactatgcagcagtcactaagcttgtaccaacgtcagtcattgcttctacaacccagaagccaccagttgttataactgcttcacagtcctctctggtcagtaatagcagcagtggcagcagcagttctacaccatcacctattcctaatacagttgcagtaacagctgtggtgtcctctacaccatctgtggtcatgtcaacagtagcacaaggtgtatctacatcagcaatcaaaatggcatcaaccagacttccttcccccaaaagcttagtgagtgccccaactcagattcttgcacagttccctaaacaacatcaacagtctcctaagcagcagttatatcaagtgcaacagcagacacagcaacaagtggcccagccttctccagtatctcatcagcaacagcctcagcagtctcctttgccacctggtattaaacctaccatccaaatcaaacaggagtcaggtgttaaaatcatcacacaacaggttcaaccaagtaaaatcttacccaaaccagtgacagcaactctacccaccagtagcaattcccctattatggtggttagcagtaatggtgcaattatgacaactaaactggtaaccactcctactggcacacaagcaacctatacccggccaacagtgagcccatccattggtcggatggctgcaacccctggagctgcaacctatgtgaaaactacgagtggtagcatcattacagtagtacccaaatcattagctaccttggggggcaagataattagcagtaatatagtttctggaacgactaccaaaatcactacaatcccaatgacttccaagcccaacgtgattgttgtacaaaagactacaggaaaaggaacgaccattcaaggcctcccgggcaaaaatgttgtcacaacgttgctaaatgctggaggagaaaagactattcagacagtgccaacaggagcaaagccagctatccttactgctacaagacccatcaccaaaatgattgtaacgcagccaaaaggaataggttctacagttcaaccagcagctaaaatcatcccaacaaaaattgtttatgggcagcaagggaaaacgcaggttcttattaaacccaaaccagtgacttttcaagcgacagttgttagtgaacaaacaagacagctagtaacagaaacattacagcaagcatccagggtagcagaggctggtaattcatctattcaggaaggaaaagaagaaccacagaattatacagatagtagttcctcttctacagagtcctcccagagttcccaagattcccagcctgtagttcatgtaattgcttcccggcgtcaggattggtcagaacatgagattgcaatggagactagccctaccataatttatcaggatgtatccagtgaatcacaatcagctacttcaacaatcaaagctctgttagaactccaacagacaacagtaaaggaaaaattggaatctaaaccaagacaacccactattgacctgagtcaaatggcagtgcctattcagatgacccaggaaaagagacattctcctgagagtccatcaattgctgtggtagagtcagaactagtagctgaatacatcactactgaacgcactgatgaggggacagaggttgcttttccccttctagtcagccatcgctcccagccccaacagccttcccagccccagcggaccctgctccagcatgtggctcagtcacagaccgcaacacagacttcggtggtggtgaagtccatcccagcatcttcccctggagcaatcacccacattatgcagcaggcattaagcagtcacactgcttttaccaaacacagcgaggaacttggaactgaggagggcgaggttgaagagatggacactttagaccctcagacaggtctgttttaccgatctgccctgactcagtcacagtcagctaaacagcagaaacttagccagcccccgctggaacagactcagctgcaagtgaaaactctgcagtgcttccagactaaacagaagcagaccatccacctgcaggcagaccagctccagcacaaactcccgcaaatgccccagctttccatcaggcatcaaaaactcacccctctccagcaagaacaagcacagcccaagccagatgtacagcacacacagcatcccatggtggccaaagacaggcagcttcctaccttaatggcacagcccccgcaaactgtagtacaggtgcttgcagtgaaaaccacgcagcagctccctaaactgcagcaggctccgaaccaaccaaaaatctacgtgcaaccccaaaccccccagagccaaatgtcgctcccagcttcttcagagaaacagacggcaagccaggtggagcagccaattataacccaaggatcctctgttacaaagataacttttgaggggcgccagcctcccacagttacaaagataactggtggcagttctgtgcctaagctgacatcaccagttacaagcatatctcccattcaggcctctgagaagacagcagtgtctgacattttgaaaatgtctttgatggaagctcagattgatacaaatgtagaacatatgatagtggatcccccaaagaaggctcttgccactagcatgctcactggtgaagcaggatcattaccctccacccacatggtggtggcagggatggcgaattccactccccagcaacagaaatgtagagagtcctgttcgagtccatccactgttggctcttccctaacgacaaggaaaattgatccaccagcagtgcctgcgacaggccagttcatgcgtattcagaatgtaggccaaaagaaagctgaagagagtccagcagaaattatcatccaggctattcctcagtatgctattccttgtcactccagctccaatgtggtggtggagcccagtgggcttcttgagctaaacaacttcactagtcaacagctggatgatgaggagacagcaatggagcaggacatagacagtagcacggaggatggaactgaacccagcccttctcagagctctgctgaacggtcctagtgtttggacacaatagtgcactttaaaacctgcttggttaccaagtgtccagggaaacccttgtattttgatgactaaaaagagcactttgcccgtacttaggctgtggaccctaaaacagcagtgtttcaacaagatgttgctgcaggagcagctttttaaaacaagataaaactcacaggggaatgtacttttttaaaaaaaaatgaaaaagaaaaaaaaagctgcacatttacagtgacttaagacctggtcttctttctctgttggatcatggccggtgaaacagttttgtcttgcagtggaaagagacttcctgtgaatgtttctcaactggtttctactgagcaaaataccatctaaaaggagaatgtgaatagttgtattttgaaatgatgtgtcaggaaaagttttttaaaaacttgtatgtttttgcaaatccctggaagtgttgaattggttaaaattttacattttctcagttcataattagtttataaacacctagaataatactggcattaaagaatccttgttggatggtagaaatcagatccctaaccagtgggaggtactttttgggtggcttgtgcattcttatcagttgtgtgctaatttattgtattgttcctttgtgctctaagcagcacacttgccttctatttatttaagtgtaaacatttcaaagcaggccgtactccttctgacaaatttcttgtaaaccaggattgcctacgctttccactgtcgtcgtctccccactttccctcttcctttaagaaaacttactaaaaaatgtttcattgcgaagcagaggaaaagaaacgttttcagacctaaaggaaatgtttggtcatgttaagaaaacaaattattcattcatatgatgctttcttaacgttgaaattgcacattcacattggactgagactttgaaaataacttttacatacttttgtttaagcccctttgaaatgtataaaaagttcatttacagttctaaatgtaatgtttttaagccttctatctttttaggacacagtttgtttaagcaatatgttttggtcttgtgatcactgtctgtcacaagtagagtgaaaggggtaagggggtgggagggtaagagttttgacaagttgtggcaaaggaaactatacttttcatttttaaaaatgtaaatagaaaagtttttaacggttttatatagatttcactataaataagcattttaagactgacaaatgttgaactgtacatacatttatcagcataactgcccagtttttttggtgctgaagtactgtaagtagaattcatcaacggtctcctaatttttgcatctacatctggggggaaaaagctgtgatactatagttaataaattcccactagagtgacaaaaaaaa

SEQ ID NO: 365 - DNA, 1722 bp, Human
tagacaaacaggcgacttggccgcccagagaggctttatccgtgactccttgatcttcttcctgcgtggagagccttcgcgggtgaggcttaacgcgcaggaggtctcacgagagtggaagcaactctcgcgaattttaaaatttatctttttgcctagcgactgacaacaggctggttgcttggcgtggaatcctaaagtggcctggctttgagactggagtgagaccccagccctaggctggggttctttccattatagaggagacggattcagaagggctacagaccaaggttgttgaaaaccagacatatgatgagcgtctagagattaacgactccgaagaggttgcaagtatttatactccaaccccaagacaccaaggacttcctcgttctgcccatcttcctaacaaggctatggctgataacagcagtgatgagtgtgaagaggaaaataacaaggagaagaagaagacctcacagttgacacctcaacggggctttagtgaaaatgaggatgacgatgatgatgatgatgattcatctgaaactgattctgattctgatgatgatgatgaagagcatggagcccctctggaaggggcctatgaccctgcagactatgagcatttgccagtttctgctgaaattaaggaactcttccagtacatcagtaggtacacacctcagttgattgacctggaccacaaactgaagcctttcattcctgattttatcccagctgtcggggatattgatgcattcttaaaggtcccacgtcctgatggaaagcctgacaaccttggcctattggtattggatgaaccttctacaaagcagtcagaccctacggtgctctcactctggttaacagagaattctaagcagcacaacatcacacaacatatgaaagtaaaaagcctagaagatgcagaaaagaatcccaaagccattgacacgtggattgagagcatctctgaattacaccgttctaagccccctgcgactgtgcactacaccaggcccatgcccgacattgacacgctgatgcaggaatggtccccggagtttgaagagcttttgggcaaggtaagcctgcccacggcagagattgattgcagcctggcagagtacattgacatgatctgtgccattctagacatccctgtctacaagagtcggatccagtccctccatctgctcttttccctctactcagaattcaagaactcacagcattttaaagctctcgctgaaggcaagaaagcattcactccttcatccaattccacctcccaagctggagacatggagacattaaccttcagctgagacacttcccaagctgctgtttcaaggctgagctggcccctctgccccagctgagatggacagatcgttgtcagctacttgatgtccttgcccatgccacagcttggctcaggggcagtgcatgtcctgctgccctctctgccagagggcacagaacatgtttgtttaatgaacctgcctgcctcagattgctgtccccggggagttaatgcatctacaccactgtggggatttgagttataagaattggaatttctgagatcccatggaggttagattgggaggaaagcttaaaagatgtcctttttgtgagagggatggaattgttttctttcattcgtaaagttagtgagtaaagattttataaatcaaatgctctattatattg

SEQ ID NO: 366 - DNA, 1518 bp, Human
ggtggcgctgttacatagcccgtagtcagaggcctttcagcccaggggccggcgcacgaaacctgtttggaggttatggatgataaacccaatcctgaagccctaagtgacagttcagagcgtcttttctcctttggcgtcatcgcagatgttcaatttgcagacttagaagatggctttaatttccaaggaaccaggcggcgatactacagacatagtcttcttcacttacagggtgccattgaagactggaataatgaaagcagcatgccctgttgtgtccttcagcttggagatatcatcgatggatataatgcacagtataatgcatccaaaaagtccctagaacttgttatggacatgttcaagaggcttaaagttccagttcatcatacatggggaaaccatgaattctataacttcagtagagagtatttaacacactctaaacttaacactaagtttctagaagatcagattgtacatcatcctgagaccatgccttcagaagattattatgcttatcattttgtaccattccctaaattccggttcattttacttgatgcatatgacttgagtgtcttgggcgtggatcagtcttctccaaaatacgagcagtgtatgaagatattgagggagcacaatccaaatacggaactgaatagtcctcaaggactttctgagccccagtttgtccagtttaatggaggattcagccaagaacagctaaactggttgaatgaagtgctaacattctctgacacaaaccaagaaaaggtggtgattgtgagccatcttcccatttacccggacgcctctgacaatgtgtgcctggcctggaactacagagatgccctggcagtcatttggtctcatgagtgtgtggtgtgtttctttgctggtcacacccatgatggtggctactctgaggatccttttggtgtataccacgtcaacctagaaggagttattgaaacagctccagacagccaagcctttggcacagttcatgtctatcctgacaaaatgatgttgaaagggagaggcagagttccagatagaattatgaattacaagaaagaaagagccttccattgttagtctaatttattttaacttgatagaaaatgagctttgtgtttgtccctcctaaacaaaaaaataaaaatcctctgtctcattgtttagtattcagcttgcataacaaaatgtatttatagtttcagtgtgtgatggttgataaaatactcagaaatgttattttggatcatgtatccattgtaagttagaaacaaaccagggaggaaactgaggcaggggtgtatagtcctcataaggggcatatagtcctcatgagggatcttatttggccctacctgattttttttaactttttacaaggagattgtattcacatgtgttaactatgtaacttcaagttcagcatataagctcaggtaagctttttctattcaccctgctgtgtaaatgagctttggacaatttctgctcaga

SEQ ID NO: 367 - DNA, 1414 bp, Human
gaagagactcccgggctcttaacgtcgggtatcaggagtttcttcccggagcaaggacccccaagacggaagaggatggccgcggcggctctgaggagattttggtcccggcgccgcgcagaggcgggcgacgcggtagtggcgaagccgggagtgtgggcgcggctggggtcctgggcccgcgcgctgctccgggactacgccgaggcctgcagggacgcttcggcggaggctagggcccggccggggcgcgccgctgtgtatgtgggtctgctgggcggcgcggcggcctgcttcacgctggcgcccagcgagggtgccttcgaggaggcgctgctggaggcgtcggggaccctcctgctgctggcgccggccacccgcaaccgcgagtccgaagccttcgtgcagaggctgctctggctgcggggccgtggccgcctgcgctacgtcaacctggggctctgctcgctggtgtacgaggcgcccttcgacgcccaggccagcctctaccaggcgcgttgccgctacctgcagccccgctggaccgacttccccggccgggtcctggacgtgggcttcgtgggtcgctggtgggtgctgggggcctggatgcgcgactgcgacatcaacgacgacgaattcctgcacctgccggcgcatttgcgggtggtcgggccccagcagctgcattccgagaccaacgagcggctcttcgatgagaagtacaagcctgtcgtgctcaccgacgatcaggtggaccaggcgctgtgggaggagcaggtcttgcagaaggagaagaaggacaggctcgccctgagccaggcccactcgctggtgcaggcggaggccccgagatgaaaccctgaggcccccgagtcctggcaaactgcttgcctggggtggtgcagttctgagtgtgcctcacctgcagaacagctgagacagatgatgtgcaaagtgttttctcactggatttgcacaagtttggggagcctttctgccccccgtctttgttctttattagctgaagctaattcagagccacctgggtccgggagttggggacagcagaacgacttgacacatgttcatcactggcagagctggtcatgagccttttatataagcctttttcatcgggcctcagaggccctccttaaggaggtaccacattggtcagctgacttgcaaactcttctaaggccacttagattttctttttcaagtttgggttgtggcctggcatggtgatgtctgtaatcccagcagtttgcaaactgaggcaagagaatcgcttgaggccaggagtttgaggccagctagagtgacatagcaagactccgatgctacaaaaaagaataataatagtaattaactaaataaaatttgagctgaaaaaaaaaaaaaaaaaaaa

SEQ ID NO: 368 - DNA, 1672 bp, Human
acgaccagcgtgctgcgtcacggcggtgcgccggaagtggctgcggatttcgccggaaatcccggaagtgacagctttgggggtttgctgctggctctgactcccgtcctgcgatgggttgcgacgggggaacaatccccaagaggcatgaactggtgaaggggccgaagaaggttgagaaggtcgacaaagatgctgaattagtggcccaatggaactattgtactctaagtcaggaaatattaagacgaccaatagttgcctgtgaacttggcagactttataacaaagatgccgtcattgaatttctcttggacaaatctgcagaaaaggctcttgggaaggcagcatctcacattaaaagcattaagaatgtgacagagctgaagctttctgataatcctgcctgggaaggggataaaggaaacactaaaggtgacaagcacgatgacctccagcgggcgcgtttcatctgccccgttgtgggcctggagatgaacggccgacacaggttctgcttccttcggtgctgcggctgtgtgttttctgagcgagccttgaaagagataaaagcggaagtttgccacacgtgtggggctgccttccaggaggatgatgtcatcatgctcaatggcaccaaggaggatgtggacgtgctgaagacaaggatggaggagagaaggctgagagcgaagctggaaaagaaaacaaagaaacccaaggcagcagagtctgtttcaaaaccagatgtcagtgaagaagccccagggccatcaaaagttaagacagggaagcctgaagaagccagccttgattctagagagaagaaaaccaacttggctcccaaaagcacagcaatgaatgagagctcttctggaaaagctgggaagcctccgtgtggagccacaaagaggtccatcgctgacagtgaagaatcggaggcctacaagtccctctttaccactcacagctccgccaagcgctccaaggaggagtctgcccactgggtcacccacacgtcctactgcttctgaagcccgcactgccaccgctcctgccccagaaggttgtttagtttccacgtaggcaggtcgctttgtgcctctgagtgcgctgctgtgtgttctctctatagttctgtgtcataaagctgtcctggccagccttcaagctggtgtggccactcttgatgtgaggcgtgtcggttccaggggggacatgggaggggctgcacagtggcccgaggtcatgcttgcttccacctgcaggtgcatttggtcctttccatggccaggaagccctgtgggctgcactttttatgcttgcagtaacaagagactccagagtcctcaccggtgcagagttggcacatattaattaactaaaattctaatgatcttgctaccagcaataaatcaagtaggccaagtgaaactgggctttaaaaaggatggatttcaaatacactgtgcccactagaagcttcgaagggcctcgtccctctgctacagccctgggaggagccaggatccttgttggtctagctaaatactgttaggggagtgtgccccatctcatcatttcgaagatagcagagtcatagttgggcacccagtgattgggttcaaaaataaagctggtctgcctcttctctcaaaaaaaaaaaaaaaaa

SEQ ID NO: 369 - DNA, 6005 bp, Human
ctcgtttccgtaggaagaagcgccgggaaagatggcggcgtctgtggtttgaattccagcggcgccgccagagtctgaacaagagctggggtggagggggcggggacctggggagcccggcgggtcgctatcgcggggggtactagtggcgccgccgccacagacaccaacgctgtcgccacctctgtagccatgatggacttggtgttggaagaggacgtcaccgtccctgggacgctcagcggctgcagtggccttgttcccagtgtaccagatgacctggatggcatcaaccccaatgctgggttgggaaatggtctgctcccaaatgtgtcagaagaaacagtgtctcccaccagagcacggaacatgaaggactttgaaaatcaaatcactgaattgaagaaagaaaactttaacctaaagctccgcatctatttccttgaggaaagaatgcaacaggaatttcatggccccactgaacatatctacaaaactaacattgagctcaaggtggaagtagaaagtctgaagcgggaactccaggagagagagcagctgctcatcaaagcctccaaagcagttgagagcttagctgaagcaggtggctctgaaatccagcgggtgaaagaagatgctcgaaagaaggtgcagcaggtggaagatctcctaactaaaagaatactccttttggaaaaggatgtgacagccgcccaggcagaactggaaaaggcctttgcagggacagagacggagaaggctcttcggttgcgtttggaaagcaagctttcagagatgaagaagatgcacgagggggacttggcgatggctctggtcctggatgagaaagacagactgattgaggagttgaagctgtctttgaagagcaaagaagctttaattcagtgccttaaagaggagaaatctcagatggcatgtcctgatgagaatgtgtcatctggagagctccgaggactttgtgctgctccaagggaagaaaaggagagagaaactgaggctgcacaaatggagcatcagaaggagagaaacagctttgaagagaggatccaggcacttgaagaggacctgagagagaaggaaagagaaattgctacagagaagaaaaatagtctaaagagggataaagccattcagggtttaaccatggcattaaaatcaaaggaaaaaaaggttgaagaacttaactctgaaattgaaaagctcagtgctgcctttgctaaagccagagaggccctacagaaagcacagacccaggaatttcaggggtctgaagactatgagactgctctatcaggaaaggaagccctttcggctgcgctgcgctcacaaaacctcaccaagagtacagagaaccacagactgcgtagaagcattaagaagatcacccaggagctgagtgacttgcagcaggagagggagagactggagaaggacctggaggaagcccatcgagagaagagcaaaggagactgcaccatccgtgatcttagaaatgaagttgaaaaattacgcaatgaagtgaatgaaagagagaaagcaatggaaaatcgttacaagagtcttctgagtgaaagcaataaaaaattgcacaatcaagagcaagtgatcaaacatctaacagaaagtaccaatcagaaggacgtgttgcttcagaaattcaatgaaaaagatttggaagtaatacagcagaactgctatttaatggctgcagaggatcttgagctcaggagtgaaggcttaataacagaaaagtgctcttctcaacagccaccaggcagcaaaaccatcttctctaaggaaaagaaacaatcatcagactatgaagagctgattcaggtcttaaagaaagagcaggacatctatacccatctggtcaaatctctgcaggaatcagacagtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagcttctggctagcaaggaggacgaggacacgatcaaaattggggaggatgacgagattaatttcctgagtgaccagcatttgcagcagagtaatgagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttcccccaccgagctcacgctgtctctttgttccaagtgtggttcctatttattgaggaagaaagagctgtctggccaaaggaaatctattttttcccttcatgttttctctctgaaagttggcttgagagttgttgtcagaaaggtgcaggtgctccacaaacgggtggtaaaaaggcctcgagctcttggatgttgtatttcagatcaggggcaggcaccggagttgaggctgtgcgccttggtgggcttcacgtcttcccctggatttgcttagtactcagccagtgccacagtttgaagattctcattaaatgattcatttcatttcaccttgaa

SEQ ID NO: 370 - DNA, 2809 bp, Human
gacagggccgcggacgcccgggcagccacggcggcggggccgcggcgggcgccggctcagcccgcccctttctcccgccgcctccccgccccgccccgcgccgcgccggccgctgtcagctccctcagcgtccggccgaggcgcggtgtatgctgagccgctgccgcagcgggctgctccacgtcctgggccttagcttcctgctgcagacccgccggccgattctcctctgctctccacgtctcatgaagccgctggtcgtgttcgtcctcggcggccccggcgccggcaaggggacccagtgcgcccgcatcgtcgaggaaatggatcagacaatggctgccaatgctcagaagaataaattcttgattgatgggtttccaagaaatcaagacaaccttcaaggatggaacaagaccatggatgggaaggcagatgtatctttcgttctcttttttgactgtaataatgagatttgtattgaacgatgtcttgagaggggaaagagtagtggtaggagtgatgacaacagagagagcttggaaaagagaattcagacctaccttcagtcaacaaagccaattattgacttatatgaagaaatggggaaagtcaagaaaatagatgcttctaaatctgttgatgaagtttttgatgaagttgtgcagatttttgacaaggaaggctaattctaaacctgaaggcatccttgaaatcatgcttgaatattgctttgatagctgctatcatgacccctttttaaggcaattctaatctttcataactacatctcaattagtggctggaaagtacatggtaaaacaaagtaaatttttttatgttcttttttttggtcacaggagtagacagtgaattcaggtttaacttcaccttagttatggtgctcaccaaacgaagggtatcagctattttttttaaaattcaaaaagaatatcccttttatagtttgtgccttctgtgagcaaaactttttagtacgcgtatatatccctctagtaatcacaacattttaggatttagggatacccgcttcctctttttcttgcaagttttaaatttccaaccttaagtgaatttgtggaccaaatttcaaaggaactttttgtgtagtcagttcttgcacaatgtgtttggtaaacaaactcaaaatggattcttaggagcattttagtgtttattaaataactgaccatttgctgtagaaagatgagaaaacttaagctttgttttactacaacttgtacaaagttgtatgacagggcatattctttgcttccaagatttgggttgggggcactaggggttcagagcctggcagaattgtcagctttagtctgacataatctaagggtatggggcaaggatcacatctaatgcttgtgttccttatactctattatatagtgttattcatgattcagctgatcttaacaaaattcgtagcagtggaaccttgaaatgcatgtggctagatttatgctaaaatgattctcagttagcattttagtaacacttcaaaggtttttttttgtttgttttctagacttaataaaagcttaggattaattagaagaagcaatctagttaaatttcccatttgtattttattttcttgaatacttttttcatagttatttgtttaaaaagatttaaaaatcattgcactttggtcagaaaaataataaatatatcttataaatgtttgattcccttccttgctatttttattcagtagatttttgtttggcatcatgttgaagcaccgaaagataaatgatttttaaaaggctatagagtccaaaggaatattcttttacaccaattcttcctttaaaaatctctgaggaatttgttttcgccttacttttttttcttctgtcacaatgctaagtggtatccgaggttcttaatatgagatttaaaatcttaaaatgtttcttattttcagcacttacatcatttggtacacagggtcaaatagggcaaataattttgtctttgtataatagatttgatatttaaagtcactggaaataggacaagttaatggatgtttttatattttaatagaatcatttatttctatgtgttatgaaattcacttaatgataaatttttcaacatacttgccattagaaaacaaagtattgctaagtactataacatattggccactaaaattcatattgagattatcttggtttcttggaagagataggaatgagttcttatctagtgttgcaggccagcaaatacagaggtggtttaatcaaacagctctagtatgaagcaagagtaaagactaaggtttcgagagcattcctactcacataagtgaagaaatctgtcagataggaatctaaatatttatagtgagattgtgaaagcaaccttaaagttttgaagaagactgatgagactaggtgctttgcttcctttcatcaggtatctttctgtggcatttgagaacagaaaccaagaaacatggtaattactaaattatgaggctttgctttttgtttgcttttaagtagaaaaacatgttggcaacattgagttttggagttgattgagataatatgacttaactagttttgtcattccatttgttaaagatacagtcaccaagaatgttttgagttttttgaaagaccccaatttaagccttgcttatttttaaattatttccattcagtgatgttggatgtatatcagttatttagtaaataatctcaataaattttgtgctgtggcctttgctaaaaaaaaaaaaaaaaaaaaaaaaaaa

SEQ ID NO: 371 - DNA, 3344 bp, Human
attcaaaccgcctgctgggtgccgtgggccattgtgcaagtcttccaggccgcggtcgaatgattctgacaagcgatgtcctggcgtccgcaataccgtagctccaagttccggaatgtctacgggaaggtggccaaccgggagcactgcttcgatgggatccccatcaccaagaatgtgcacgacaaccacttctgtgccgtcaacacccgcttcctggccatcgtcaccgagagcgcagggggcggctccttcctcgtcatccccctggagcagacaggcaggattgaacccaactaccccaaggtctgcggccaccagggcaatgtgctggatatcaaatggaaccccttcatcgacaacatcattgcctcgtgctcggaggacacgtcggtgcggatctgggagatccccgagggcgggctgaagcggaacatgacggaggcgctcctggagctgcacgggcacagccggcgtgtggggctggtcgagtggcaccccaccaccaacaacatcctgttcagcgctggctacgactacaaggtcctcatctggaacctggatgtgggtgagccggtgaagatgattgactgccacacggatgtgatcctctgcatgtccttcaacacggacggcagcctgctcaccaccacgtgcaaggacaagaagctgcgtgtgattgagccccgctctggccgtgttctgcaggaggccaactgcaaaaaccacagagtgaaccgggtggtgttcctggggaacatgaagcggctcctcacgacaggggtctccaggtggaacacaagacagattgccctctgggaccaggaggacctctccatgcccctgatcgaagaggaaattgatgggctctctggcctcctgttccccttctatgatgctgacacccacatgctctacctggctggaaagggtgatggaaacatccggtactacgagatcagcactgagaagccctacctgagttacctcatggagttccgctccccagccccgcagaaaggcctaggggtcatgcccaagcacgggctggatgtgtcagcctgcgaggtgttccgcttctacaagctggtgactctcaagggcctgatcgagcccatctccatgatcgtgccccggaggtcagattcctaccaggaagacatttacccaatgacaccaggcacggagccagcactgaccccggatgaatggctgggaggcatcaaccgagatcccgtgctgatgtctttgaaagaaggctataagaagtcctcaaaaatggtatttaaggctcccatcaaagaaaagaagagtgttgtggtcaacggaatagatttattagaaaatgtcccacccaggacagagaatgagctccttcgaatgttcttccggcagcaggatgagattcgacggttgaaagaggagctggcccagaaggacatccgcattcggcagctccagctggaactgaaaaacttgcgcaacagccccaagaactgttagctccccagctgggctgttttctaagccgatctctccgtcgtttctactcatcccttaacttctcccttaccagtgaccccagagacagagccaggacaggagtgggggccagcctgaggacccccgcctaccacctcgagaactggaagccaacctctaacctcctgacctcatgctaataaaagtccccagcttctggagaccccctgccggcagcccctttccctgccaccccaggagccaggcttcccctcagctgggtgaagactacagactccctggggttggcaggggctccatctcagtggaccaggaagcaagaggggaagcgggatcccagctagacttagaacttggacttttcccctgtgaagggggctgccaggacatctcagcactcccgcctggagctctcagcatcactgaaggtaccacagtgtaagtgctggactgcaggctgcagtgatccctctttcgtcccaccccctcttccctcagcagccccggaagcctgcctcacccgacgaggacagcgagcggcccggctcctttctgtctcttcccttcccaccctcttgtcttcagggaattcagaggattgctctccaaggccataatgaccccttgccttccccatgattctctacaaagctcttgcacacccttttcccattcaatttgtgagccaggcagggtagggattagtgtccccctttgacaaatgacagaactgagggttgcaatggggaaatgacttataaagtcacccagcaggtcaacaatgggcccacgaccaagaccctgggtgttcagaccccaaggccagggcctttcccgctgcatcaagatgccaatccctttgtgggcttcaccagtgcccaagtctctatggagaatgagaactggaagccactgctaccgtctacccagcaccagtagtgccgatgtgccacactgcccagttgaggcccctcacgctctgtgcccctagatccttcaggtccccaccctcagctgtcaccaccaccctccccaggggactccatctgagatgaggcctcgtcctcctggaagctgaggctgagaagggtggagcttggccctggggaaggcagaccagggtctgatggcttctagggatgctctgcgtgtgtctcagcaccgctatctcagccactttcagccttatgcacgtagaatgaccacagccactcgcatccgtatagcactttaaagtttctgcagtcctttgacacataggatctcatggagcctcacgtctactcccttctgcagatgaggaaaccgagagaagtggcccaaggtcacgcaactctgagatgccacatttcatttgatcttgtacacattttcttttattccttcttttttcctcctttcatttcccactacgcacaaagagtttataaacactgttctcagaagagtcacagtttggggtgagatctggaaatcaagaaatgggtgtccactcttttctttcattagctaggatctactagatgcattatactccatacctgcttttcccatggccgccctacggaaaatcccatccacagaggccagggctacccaagcccctccaggtgagctgggcctttcctttatgaacctccatcctcccagccagctacagtagggcctcctcaccccgtaccccacagctagacagtgtcagcactcatctcctcctcccacatttctggagcttttttttttccttccccattgacctttgtggtcttctgtgattatttatgctgcctcccaaggatagaattgaaataaaatgttttcaacttatcaaaaaaaaaaaa

SEQ ID NO: 372 - DNA, 784 bp, Human
gcccacgcgccagagtcgcagtgggcgggcctacgtgctccgcccgctgtgagcctgtccggcccccgcccgctccggagcaacccgcgagcttacaccggcttctctctgtcctcagcccgcgcgccgccatcgccgtcatgctgggcgccgctctccgccgctgcgctgtggccgcaaccacccgggccgaccctcgaggcctcctgcactccgcccggacccccggccccgccgtggctatccagtcagttcgctgctattcccatgggtcacaggagacagatgaggagtttgatgctcgctgggtaacatacttcaacaagccagatatagatgcctgggaattgcgtaaagggataaacacacttgttacctatgatatggttccagagcccaaaatcattgatgctgctttgcgggcatgcagacggttaaatgattttgctagtacagttcgtatcctagaggttgttaaggacaaagcaggacctcataaggaaatctacccctatgtcatccaggaacttagaccaactttaaatgaactgggaatctccactccggaggaactgggccttgacaaagtgtaaaccgcatggatgggcttccccaaggatttattgacattgctacttgagtgtgaacagttacctggaaatactgatgataacatattaccttatttgaacaagttttcctttattgagtaccaagccatgtaatggtaacttggactttaataaaagggaaatgagtttgaactgaaaaaaaaaaaaaaaaa

SEQ ID NO: 373 - DNA, 3441 bp, Human
gaggagtgagcgagcggcgaccctcacctcgcctcccgcctagctcctgcgcagccagcgggtaccgggagctgcggccagcgccgcttctttcctttccttttctctccgttttccttctccttccccggaggagaaaacaaataaagaagagcaaatagccgggaggcgctcggcatccaggacgttccctcccccgatccaagttggaattagcatcctctcggggggtttcatcaccttaaatggttttgaaccaatgaaggtgtattcccttaaaaagacggacagcccatcgtgtgaactatagagtttgtggacagatttatattgggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcaaaaaaaaaaaaaaaagtattaagtttcacaagctgtttgtactcaaatatattttctcagtttcagatcctctgctattttattgagtggaaagtcttgagctaaaagggttcaagaagaataatgttgcatttccttatgtctcaggaaacactttttatggtaacttgtcagattgtctatgaacaaacccacttttttagacattgataaagtcttcttttcttcacgtgatattttatacaagaacacttcagatgtattagatgtgactgattttaacaaatcctattagatttgtatcaactagttacatgttctattcatagtcttttgtgaatcattgcctttttgtttaaaaagatggcctattttgagcctttgtataggtacattcctgtttttgtgacaaaagaaaaactttaaaattgtcccaaacagaaaaataatggctatcagaagtatgttttgttttagtgtgagttaccgttactgtatttgtttattgtaaaggtggacatttagcgttcagtgcagttttcaataaaaagtaattaaaatttgttaagttctgaaattcaagtacatctcactaatgtaaatgttctctacttgagatgtttaaggcaattgcattgtcaattagccaatttccagctcttgttactacagggttccataaccagactcaagaccgctgacaattaattacctgtgataacaaaaagtttaattgaaaaatcaaaacctcacacaagtccatcattatcacgtcatgccatccttaagatgcaatggtgggttagtgctaaatcaattcaaaaaaaaacaaagttgctcaacttttagagttctgactttaatctaccccaaagcaaaatgacctggacctggttcaagggagggaagtgaaccttgaaactgttttgccaataacctaacaaacaaaatgatatttacaaagaagtgttgcaaatagtcccatgagttaagagcttgatttaatggatcttctttttaaatagaattaaacctttatactaaaagta

SEQ ID NO: 374 - DNA, 2406 bp, Human
ctcccacagcctttgctatatcaagggccagggtcaaaggcctcccagcagacagagagaggaggttgtctgggacagactgctcctgacagaaggatgtcccagctgagcctgtcctggctgggcctctggccagtggcagcatccccttggctgctcctcctgctggtcggggcctcctggctcctggcccatgtcctggcctggacctacgccttctatgacaactgccgccgccttcggtgtttcccacaacccccaagacggaactggttttggggacaccagggcatggtcaaccccacagaggagggcatgagagttctgactcagctggtggccacctacccccagggctttaaggtctggatgggacccatctcccccctcctcagtttgtgccaccccgacatcatccggtctgtcatcaacgcctcagctgccattgcaccaaaggacaagttcttctacagcttcctggagccctggctgggggatgggctcctgctgagtgctggtgacaagtggagccgccaccgtcggatgctgacgcctgccttccatttcaacatcctgaagccctatatgaagattttcaatgagagtgtgaacatcatgcacgccaagtggcagctcctggcctcagagggtagtgcctgtttggatatgtttgagcacatcagcctcatgaccttggacagtctacagaaatgtgtcttcagctttgacagccattgtcaggagaaacccagtgaatatattgccgccatcttggagctcagtgcccttgtatcaaaaagacaccatgagatcctcctgcatattgacttcctgtattatctcacccctgatgggcagcgtttccgcagggcctgccgcctggtgcacgacttcacagatgccgtcatccaggagcggcgccgcactctccctagccagggtgttgatgacttcctccaagccaaggccaaatccaagactttggacttcattgatgtactcctgctgagcaaggatgaagacgggaagaagttatctgatgaggacataagagcagaagctgacacctttatgtttgagggccatgacaccacggccagtggtctctcctgggtcctgtaccaccttgcaaagcacccagaataccaggagcgctgccggcaggaggtgcaagaacttctgaaggaccgtgagcctaaagagattgaatgggacgacctggcccatttgcccttcctgaccatgtgcatgaaggagagcctgcggctgcatcccccagtcccggtcatctcccgccatgtcacccaggacattgtgctcccagacggccgggtcatccccaaaggcattatctgcctcatcagtgttttcggaacccatcacaacccagctgtgtggccggaccctgaggtctacgacccctttcgctttgacccagagaacatcaaggagaggtcacctctggcttttattcccttctcggcagggcccaggaactgcatcgggcagacgttcgcgatggcggagatgaaggtggtcctggcgctcacgctgctgcgcttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgaagcctagaattaccctaagaccctgttccacagtcctgtattccatcctagatatctactcaaaataattgagacaagtgttcaaacagaaagacgcttgtgcgtgaatgttcatggcggccctattcacagtagccaaacgatgaaaacaaccccaagctatatattaccagatgaaaggataaacaaaatgtggtccatccatacaatggagtattacacagccataaaaaggaatgaagcagtgatccctactacactgtggatgaaccttgaatgcatgatactgaatgaaagacgtcagatgcaaaaggtcacatagtgtactgtccttttatacgaaatttccagaacaggccaatctgaagagatgcatagcggattggtggctttcagcagctgtggggaggtgggactgaggagcgactgctaatcagtatggggtttcctcccgggatggtgaaaatgttccggacctagatagtgacgaaggtagcacgacactgtgagtgcactaaatgctattgaattggacactttgaaatggtgaatttcgtggtatgtgaattctacctcaatcaaaaaaatttgctattttatctcacatacattttttttctgtccaggttgttcatataataatatgctgtgagcatctttccatgacattaaatcatcttaggaaacatt

SEQ ID NO: 375 - DNA, 5688 bp, Human
ggtgggggtagcggcggcgcccgcggcccggagcgggggttgggggagtagagaaagcggggcgcgcggaggaacgctgggtccccggcgccgcgggagctgggaggaccgagccggccgagcgagcagcgcggcagcacagtccccgcgtggcgcagcgcggcggggacgcggggaccgcccggatctccttccactgcgccccgcgctctgcggtcctcggccgcctcttcttccttcactcactgcccgggcgggagcggcgcccaagtcgggtgcgccatgtctggggccgggtagccccgccgcccgccggcccgccagctcgccctccgagccacccgccagcgggccggccggccgggaagcgcgggacagatgcagtgagtgaggggggggccatggcggaggagcggcccccccggctggtggattacttcgtggtagctgggcttgcagggaacggagcacccatccctgaggaaacgtgggttcctgaacccagtgggcccctgcgccctccccggccagctgagcccatcacagatgtggcagtcatcgctagggcactgggcgaggaagtgccccagggctacacatgcatccaggcttctgctgggggccaccccttggaactcagtgctggacttctgggtggaactcaacccgtcatctgctaccgcaggggccgtgacaagccccccctcgttgagctgggggtgttgtatgaggggaaggaacgtcccaagcctggcttccaagtgcttgacacgacaccctacagccactcagcaaacctggcccctccaggccccgggcacccccgcacctacctcacttaccggcgggcagcagagggggcagggctgcatgccctgggcatcactgacctctgcctggtgctgcccagtaagggcgagggcactcctcatacttactgccggctgccccgcaacctcaaccctggcatgtggggcccagcagtgtacctgtgctataaggtgggcctggcgaaggccaacacgctggtgtacgaggcagagctgctgggccgctacccggaggaggacaatgaggcgttcccgctgcccgagtcagtgcccgtcttctgcctgcccatgggggccactatcgagtgctggcctgcccagaccaagtaccccgtgcccgtcttctccacctttgtgctcacgggtgcagctggtgataaggtgtatggtgccgccctgcagttctacgaggcgttcccaagggccaggctatcagagcgacaggcacgggcactgggcctgctgagcgccgtggagcggggtcgggcactggggggcagagctgtgcgcagccggcgtgccatcgctgtgctgtcccgctggcctgccttccctgccttccgcgccttcctcaccttcctttaccgctactccgtctcaggcccccaccgcctacccttggaagcgcacatctcccacttcattcacaacgttcccttcccttccccacagagaccccgcatcctagtgcagatgtctccctatgacaacttgctcctctgtcagcctgtatcctcacccctgcccctcagtggtgccagcttcctgcagctgctgcagagcctgggccctgagctggctatcacactgctgctggctgtgctcacagagcacaagctgctagtccactcgctgcggccagacctgctcaccagcgtctgtgaggccctcgtctcgatgatcttcccactgcactggcagtgcccctacattcctctgtgcccgctggtgctggcagatgtgctgagtgccccagtgcccttcattgtgggtatccactccagctactttgatctgcatgacccgcctgctgatgtcatctgtgtagaccttgataccaacacgctcttccagactgaggaaaagaagctcctctcccctcggaccctgccccgcagaccctacaaggttctgctggccacactgacaaacctgtaccagcagctggaccagacatacactggacctgaggaggaagcatccctggagttcctactgacagactacgaggcagtgtgtggccgcagggcccggctggagcgcgaagtccaaggagccttcctccgcttcatggcctgtctgctcaagggctaccgggtcttcctgcgcccactcacccaggccccctccgagggagctcgtgatgttgacaaccttttcttcctgcagggcttcctcaaatcccgggaacgctccagccacaaactttactctcagctgctgcacacacagatgttctcacagttcattgaggagtgctcttttggctctgctcgccatgctgcccttgaattctttgactcttgtgttgaaaaggtccacccagagcaggagaagcctgagccgacacccttagtggagctagaggagctgtcaggaagtgagctcactgtctttatcacacctcccgaggagcctgccttaccagagggcagtgaatccactccccagtactgctatgatggattcccagagctacgggctgagttgtttgagtctcttcaagagcaacctggggccctgcctgtgccaggcccttcccgtagcgcccccagcagtcctgctcctcgccgtaccaaacaggagatgaaagttgcacagcggatggcacagaagtcagcagctgtgcctgagctgtgggcccggtgcctgctggggcactgctatgggctgtggttcctgtgtctgcctgcctatgtgcggtcggcaccctcccgagtgcaggcactgcacacagcctaccatgtgctgcgccagatggagagcggcaaggtggtgctccctgatgaggtgtgttaccgggtactgatgcagctctgctcacactatgggcagcctgtgctgtctgtgcgggtcatgctggagatgcgtcaggcaggcattgtgcccaacaccatcacctatggctactacaataaggctgtgttggaaagcaagtggccgtctggcacaccaggtgggcgtctgcgctgggccaagctccggaatgttgtcctgggggctgctcagttccgccagcccttgagagaacggcaacagcagcagcagcagcaacagcagcagcagcagcagcagcagcaggagcaggtgtcagcacatcaagaggcaggcagctcccaggcagagccctatttggagcgcccttcccctactcgccctcttcagcgccagactacttgggctgggcgaagtctgagagacccagcctcaccccctggacgcctggtgaagagtggtagcctgggcagtgcccgaggggcacagcccactgtggaggccggtgtggcccacatgatagaggccttgggggtcctggaaccccggggatcacctgtgccctggcacgatggaagtctctcagacctgagcctgacaggggaggagccgctccctggaggcagcccagggggctcaggctcagccctgagtgcccagtccactgaggccctggaagggctaagtgggcggggacccaaggctggtgggcgacaggatgaggcaggcaccccccgacgagggctgggtgcccgcctccaacagctgctcactccttcccgccactcccctgcctcccgcattcccccacctgagctgcctcctgacctgccacccccagcccgccgcagccccatggacagtcttctgcacccccgggagcgccctggatccactgcctccgagagctcagcctctctgggcagtgagtgggacctctcagaatcttctctcagcaacctgagtcttcgccgttcctcagagcgcctcagtgacacccctggatccttccagtcaccttccctggaaattctgctgtccagctgctccctgtgccgtgcctgtgattcgctggtgtatgatgaggaaatcatggctggctgggcacctgatgactctaacctcaacacaacctgccccttctgcgcctgcccctttgtgcccctgctcagtgtccagacccttgattcccggcccagtgtccccagccccaaatctgctggtgccagtggcagcaaagatgctcctgtccctggtggtcctggccctgtgctcagtgaccgaaggctctgccttgctctggatgagccccagctctgcaacgggcacatggggggagcctcccggcgggttgagagtggggcatgggcatacctgagccccctggtgctgcgtaaggagctggagtcgctggtagagaacgagggcagtgaggtgctggcgttgcctgaactgccctctgcccaccccatcatcttctggaaccttttgtggtatttccaacggctacgcctgcccagtattctaccaggcctggtgctggcctcctgtgatgggccttcgcactcccaggccccatctccttggctaacccctgatccagcctctgttcaggtacggctgctgtgggatgtactgacccctgaccccaatagctgcccacctctctatgtgctctggagggtccacagccagatcccccagcgggtggtatggccaggccctgtacctgcatcccttagtttggcactgttggagtcagtgctgcgccatgttggactcaatgaagtgcacaaggctgtggggctcctgctggaaactctagggcccccacccactggcctgcacctgcagaggggaatctaccgtgagatattattcctgacaatggctgctctgggcaaggaccacgtggacatagtggccttcgataagaagtacaagtctgcctttaacaagctggccagcagcatgggcaaggaggagctgaggcaccggcgggcgcagatgcccactcccaaggccattgactgccgaaaatgttttggagcacctccagaatgctagagaccttaagcttccctctccagcctagggtggggaagtgaggaagaagggattctagagttaaactgcttccctgttgccttcatggagttgggaacaggctgggaaggatgcccagtcaaaggctccaagcgaggacaacaggaagagggatccactgttaccaaaagtcctgattcccccatcaccaacctacccagtttgttcgtgctgatgttgggggagatctggggggagttggtacagctctgttcttcccttgtcctataccgggaactcccctccagggtacccacagatctgcattgccctggtcattttagaagtttttgttttaaaaaacaactggaaagatgcagagctactgagcctttgccctgaatgggaggtagggatgtcattctccaccaataatggtccctcttccctgacgttgctgaaggagcccaaggctctccatgcctttctacctaagtgtttgtattttattttaaattatttattctggagccacagcccccttgcttatgaggttcttatggagagtgagaaagggaagggaaatagggcaccatggtccggtggtttgtagttccttcaaagtcaggcactgggagctagaggagtctcaagctccccttaggaagaactggtgccccctccagtcctaatttttcttgcctgccccgccttggggaatgcctcacccacccaggtcctgacctgtgcaataaggattgttccctgcgaagttttgttggatgtaaatatagtaaaagctgcttctgtctttttc

SEQ ID NO: 376 - DNA, 1315 bp, Human
ctactctgtcaccgcccctgggaagagtggaacccatacttgctggtctgatccatgcacaaggcggggctgctaggcctctgtgcccgggcttggaattcggtgcggatggccagctccgggatgacccgccgggacccgctcgcaaataaggtggccctggtaacggcctccaccgacgggatcggcttcgccatcgcccggcgtttggcccaggacggggcccatgtggtcgtcagcagccggaagcagcagaatgtggaccaggcggtggccacgctgcagggggaggggctgagcgtgacgggcaccgtgtgccatgtggggaaggcggaggaccgggagcggctggtggccacggctgtgaagcttcatggaggtatcgatatcctagtctccaatgctgctgtcaaccctttctttggaagcataatggatgtcactgaggaggtgtgggacaagactctggacattaatgtgaaggccccagccctgatgacaaaggcagtggtgccagaaatggagaaacgaggaggcggctcagtggtgatcgtgtcttccatagcagccttcagtccatctcctggcttcagtccttacaatgtcagtaaaacagccttgctgggcctgaccaagaccctggccatagagctggccccaaggaacattagggtgaactgcctagcacctggacttatcaagactagcttcagcaggatgctctggatggacaaggaaaaagaggaaagcatgaaagaaaccctgcggataagaaggttaggcgagccagaggattgtgctggcatcgtgtctttcctgtgctctgaagatgccagctacatcactggggaaacagtggtggtgggtggaggaaccccgtcccgcctctgaggaccgggagacagcccacaggccagagttgggctctagctcctggtgctgttcccgcattcacccactggcctttcccacctctgctcaccttactgttcacctcatcaaatcagttctgccctgtgaaaagatccagccttccctgccgtcaaggtggcgtcttactcgggatttctgctgttgttgtggccttgggtaaaggcctcccctgagaacacaggacaggcctgctgacaaggctgagtctaccttggcaaagaccaagatattttttcccgggccactggggaatctgaggggtgatgggagagaaggaacctggagtggaaggagcagagttgcaaattaacaacttgcaaatgaggtgcaaataaaatgcagatgattgcgcggctttgaatccaaaaaaaaaaaaaaaaaa

SEQ ID NO: 377 - DNA, 1429 bp, Human
cgcgcgcggggcgggaacgcggaaggggctggggttgcggcgcggcggcgaggaccagaccgggggcggggccggtagtgggagtgcggggcgcgcggtgacagcgcggggttggcggcgtgggacccagggggcgacagaggcagcagcagcccgaggcctgaggagaggagaccggcggcggcggcaatgctggagacccttcgcgagcggctgctgagcgtgcagcaggatttcacctccgggctgaagactttaagtgacaagtcaagagaagcaaaagtgaaaagcaaacccaggactgttccatttttgccaaagtactctgctggattagaattacttagcaggtatgaggatacatgggctgcacttcacagaagagccaaagactgtgcaagtgctggagagctggtggatagcgaggtggtcatgctttctgcgcactgggagaagaaaaagacaagcctcgtggagctgcaagagcagctccagcagctcccagctttaatcgcagacttagaatccatgacagcaaatctgactcatttagaggcgagttttgaggaggtagagaacaacctgctgcatctggaagacttatgtgggcagtgtgaattagaaagatgcaaacatatgcagtcccagcaactggagaattacaagaaaaataagaggaaggaacttgaaaccttcaaagctgaactagatgcagagcacgcccagaaggtcctggaaatggagcacacccagcaaatgaagctgaaggagcggcagaagttttttgaggaagccttccagcaggacatggagcagtacctgtccactggctacctgcagattgcagagcggcgagagcccataggcagcatgtcatccatggaagtgaacgtggacatgctggagcagatggacctgatggacatatcggaccaggaggccctggacgtcttcctgaactctggaggagaagagaacactgtgctgtcccccgccttagggcctgaatccagtacctgtcagaatgagattaccctccaggttccaaatccctcagaattaagagccaagccaccttcttcttcctccacctgcaccgactcggccacccgggacatcagtgagggtggggagtcccccgttgttcagtccgatgaggaggaagttcaggtggacactgccctggccacatcacacactgacagagaggccactccggatggtggtgaggacagcgactcttaaattgggacatgggcgttgtctggccacactggaatccagttttggctgtatgcggaattccacctggaaagccaggttgttttatagaggttcttgatttttacataattgccaataatgtgtgagaaacttaaagaacagctaacaataaagtgtgaggacggtaaactgagaaaaaaaaaaa

SEQ ID NO: 378 - DNA, 2381 bp, Human
gacaccactggccgcgaagcgcagggggggcgcgcgcgctgccgcccgttcccagcacttgtgcagactcctccggggaagagcggcctccgcggtcatctccaacggaattctgcctttgaagtgtcggggcacggcgcgtcgagggtcctggcggccaggcggggcgtgtgcaagggtcgcgtcccccccccgggcccccggcccgtggctcttggtagagcccagtgcttcatttcccgtgcgcggcccgggcggccctccctttcatcagtcttcccgcgtccgccgattcctcctccttggtcgccgcgtccttggctggcgtgaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgcgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgggtggcctggtgcctcgaagctgcctccctgtctcaccgacccggtcctcggtctggcctgtccgtgtccagcctgagacccaacagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggccctctggctccgtcctggtcatttcctgctc

SEQ ID NO: 379 - DNA, 1607 bp, Human
ctctccgctgagtgtgcttcccctccgtcatccatcgctcggcggtcttctcttctccatgggtctgctctgcgcgttccatcgagtttctcggccatcgcgcgcctgcgccattgggctgtcagtcagaggcggcgtggagatcgctgggagcggttgcggcgtgccgggagctgagttatagctgtgacttctgccctgccaggccgcacacaagctggctgacccggtttgtaaaaatggaatttcaagcagtagtgatggcagtaggtggaggatctcggatgacagacctaacttccagcattcccaaacctctgcttccagttgggaacaaacctttaatttggtacccattgaacctgcttgagcgtgttggatttgaagaagtcattgtggttacaaccagggatgttcaaaaggctctatgtgcagaattcaagatgaaaatgaagccagatattgtgtgtattcctgatgacgctgacatgggaactgcagattctttgcgctacatatatccaaaacttaagacagatgtgctggtgctgagctgtgatctgataacagacgttgccttacatgaggttgtggacctgtttagagcttatgatgcatcacttgctatgttgatgagaaaaggccaagatagcatagaacctgttcccggtcaaaaggggaaaaaaaaagcagtggagcagcgtgacttcattggagtggacagcacaggaaagaggctgctcttcatggctaatgaagcagacttggatgaagagctggtcattaagggatccatcctacagaagcatcctagaatacgtttccacacgggtcttgtggatgcccacctctactgtttgaaaaaatacatcgtggatttcctaatggaaaatgggtcaataacttctatccggagtgaactgattccatatttagtgagaaaacagttttcctcagcttcctcacaacagggacaagaagaaaaagaggaggatctaaagaaaaaggagctgaagtccttagatatctacagttttataaaagaagccaatacactgaacctggctccctatgatgcctgctggaatgcctgtcgaggagacaggtgggaagacttgtccagatcacaggtgcgctgctatgtccacatcatgaaagaggggctctgctctcgagtgagcacactgggactctacatggaagcaaacagacaggtgcccaaattgctgtctgctctctgtccagaagaaccaccagtccattcgtcagcccagattgtcagcaaacacctggttggagttgacagcctcattgggccagagacacagattggagagaagtcatccattaagcgctcagtcattggctcatcctgtctcataaaagatagagtgactattaccaattgccttctcatgaactcagtcactgtggaggaagggtatgtttccccctgtacccacttgaggcaaagataatggaaaaatgccttcaaaattctgaaggaaggttaattttaacctaaaattgtatacccaggcaaagtgctaatcaagagggcaatagaataaaaacattttcagatatcaaaaaaaaaaaaaaaaaaa

SEQ ID NO: 380 - DNA, 3156 bp, Human
actccgcaacctgtcgctcaggttcctcctctcccggccccgccccggcccggccccgccgagcgtcccacccgcccgcgggagacctggcgccccggccgaggcgcgaacagacggacgcaccggcgagcgccgaggggacaggccgagcgcggggcgccggaggcaggtgtgggacaggcactggcctcagaccggggccacactgaggtctgcccttctcccgctggccgccacccaagacaccatgagccagtccggggccgtgagctgctgcccgggtgccaccaatggcagcctgggccggtccgacggtgtggccaagatgagccccaaggacctgtttgagcagaggaagaagtattccaactccaacgtcatcatgcacgagacctcgcagtaccacgtccagcacctggccacattcatcatggacaagagcgaagccatcacgtctgtggacgacgccatccggaagctggtgcagctgagctccaaggagaagatctggacccaggagatgctgctgcaggtgaacgaccagtcgctgcggctgctggacatcgagtcacaggaggagctggaagacttcccgctgcccacggtgcagcgcagccagacggtcctcaaccagctgcgctacccgtctgtgctgctgctcgtgtgccaggactcggagcagagcaagccggatgtccacttcttccactgcgatgaggtggaggcagagctggtgcacgaggacatcgagagcgcgttggccgactgccggctgggcaagaagatgcggccgcagaccctgaagggacaccaggagaagattcggcagcggcagtccatcctgcctcctccccagggcccggcgcccatccccttccagcaccgcggcggggattccccggaggccaagaatcgcgtgggcccgcaggtgccactcagcgagccaggtttccgccgtcgggagtcgcaggaggagccgcgggccgtgctggctcagaagatagagaaggagacgcaaatcctcaactgcgccctggacgacatcgagtggtttgtggcccggctgcagaaggcagccgaggctttcaagcagctgaaccagcggaaaaaggggaagaagaagggcaagaaggcgccagcagagggcgtcctcacactgcgggcacggcccccctctgagggcgagttcatcgactgcttccagaaaatcaagctggcgattaacttgctggcaaagctgcagaagcacatccagaaccccagcgccgcggagctcgtgcacttcctcttcgggcctctggacctgatcgtcaacacctgcagtggcccagacatcgcacgctccgtctcctgcccactgctctcccgagatgccgtggacttcctgcgcggccacctggtccctaaggagatgtcgctgtgggagtcactgggagagagctggatgcggccccgttccgagtggccgcgggagccacaggtgcccctctacgtgcccaagttccacagcggctgggagcctcctgtggatgtgctgcaggaggccccctgggaggtggaggggctggcgtctgcccccatcgaggaggtgagtccagtgagccgacagtccataagaaactcccagaagcacagccccacttcagagcccacccccccgggggatgccctaccaccagtcagctccccacatactcacaggggctaccagccaacaccagccatggccaagtacgtcaagatcctgtatgacttcacagcccgaaatgccaacgagctatcggtgctcaaggatgaggtcctagaggtgctggaggacggccggcagtggtggaagctgcgcagccgcagcggccaggcggggtacgtgccctgcaacatcctaggcgaggcgcgaccggaggacgccggcgccccgttcgagcaggccggtcagaagtactggggccccgccagcccgacccacaagctacccccaagcttcccggggaacaaagacgagctcatgcagcacatggacgaggtcaacgacgagctcatccggaaaatcagcaacatcagggcgcagccacagaggcacttccgcgtggagcgcagccagcccgtgagccagccgctcacctacgagtcgggtccggacgaggtccgcgcctggctggaagccaaggccttcagcccgcggatcgtggagaacctgggcatcctgaccgggccgcagctcttctccctcaacaaggaggagctgaagaaagtgtgcggcgaggagggcgtccgcgtgtacagccagctcaccatgcagaaggccttcctggagaagcagcaaagtgggtcggagctggaagaactcatgaacaagtttcattccatgaatcagaggaggggggaggacagctaggcccagctgccttgggctggggcctgcggaggggaagcccacccacaatgcatggagtattatttttatatgtgtatgtattttgtatcaaggacacggagggggtgtggtgctggctagaggtccctgcccctgtctggaggcacaacgcccatccttaggccaaacagtacccaaggcctcagcccacaccaagactaatctcagccaaacctgctgcttggtggtgccagccccttgtccaccttctcttgaggccacagaactccctggggctggggcctctttctctggcctcccctgtgcacctggggggtcctggcccctgtgatgctcccccatccccacccacttctacatccatccacaccccagggtgagctggagctccaggctggccaggctgaacctcgcacacacgcagagttctgctccctgaggggggcccgggaggggctccagcaggaggccgtgggtgccattcgggggaaagtgggggaacgacacacacttcacctgcaagggccgacaacgcaggggacaccgtgccggcttcagacactcccagcgcccactcttacaggcccaggactggagctttctctggccaagtttcaggccaatgatccccgcatggtgttgggggtgctggtgtgtcttggtgcctggacttgagtctcaccctacagatgagaggtggctgaggcaccagggctaagcaattaaaccagttaagtctcccaggaaaaaaaaaaaaaaaa

SEQ ID NO: 381 - DNA, 1781 bp, Human
cggggaaggggtggggtggaggcgggagcggagccgggcgccgccggagctgcgcggggagcgctcgctggctggctggctggctggctctccgctgcgctgcgctgcgctccggccgctcccgcggcccgtggatgggggtgtccggctgagccccgggatccgcctccctccgccaggacccgcacagataaactcatcctgaaagtcgctgttgttctcctgctgagcaagaatggaggccccactggtgagtctggatgaagagtttgaggaccttcgaccctcctgctcggaggacccggaggagaagccccagtgtttctatggttcatctccccaccatctcgaggacccctccctctccgagcttgagaatttttcttccgaaataatcagcttcaagtccatggaggacctcgtaaatgaatttgatgagaagctcaatgtctgctttcggaactacaacgccaagaccgagaacctagctcccgtgaagaaccagttacagatccaagaggaggaggagacccttcaggacgaggaggtttgggatgctctgacagacaattacatcccttcactctcagaagactggagggatccaaacatcgaggctctgaatggcaactgctctgacactgagatccatgagaaagaagaggaagagttcaatgagaagagtgaaaatgattccggtatcaacgaggagcctctgctcacagcagatcaggtaattgaggagattgaggaaatgatgcagaactccccagaccctgaggaagaagaggaggttctggaagaagaggatggaggagaaacttcctcccaggcagactcggtcctcctgcaggagatgcaggcattgacacagaccttcaacaacaactggtcctatgaagggctgaggcacatgtctgggtctgagctgaccgagctgctggaccaggtggagggtgccatccgtgacttctcggaggagctggtgcagcagctggcccgccgggacgagctggagtttgagaaggaagtgaagaactcctttatcacggtgcttattgaggttcagaacaagcagaaggagcagcgagaactgatgaaaaagaggcggaaagagaaagggctgagcctgcagagcagccggatagagaagggaaaccagatgcctctcaagcgcttcagcatggaaggcatctccaacattctgcagagtggcatccgccagacctttggctcctcaggaactgacaaacagtatctgaacacagtcattccttacgagaagaaagcctctcctccctcagtggaagacctgcagatgctgacaaacattctctttgccatgaaggaggataatgagaaggtgcctactttgctaacggactacattttaaaagtgctctgccctacctaaccttgccctttggagcagcctcgctgcaggaggtcactgagcaagagtcattccatcacagggactgcatgagaccatgtaacctccgacatgtatttaaacgtgtatagcttaacctggattaaacacgagcaagcgcgcggggtcctttgccgttggcttctagtgctagtaatcattggatgcatgatggggcagggccggtgatggtgcctcccccttgctggtgtcaggagaggggaaggcagccgctttcaccgctcattatgtagtctggctacagccctcaaaaacagcttatactcttaagactaattttgaaataaaaccttcatttaattaatattcttaaaaaaaaaaaaaaaaa

SEQ ID NO: 382 - DNA, 3207 bp, Human
gctaagtcaacatataacagcaaacttacaacaattatttaacatttttaaagccatgaagaagggacagagcacggagcggccggggagagcggcagagccagaggcagaggcacggctggctccccgggagggcccttgcggcgcggggcgcagtgcctaggccgcccgggtctcctgcgttgcggggagcgcagcgcaggctctcgcttgccatgagtcacctcttcgatccccggctgcctgccctggccgcctcgcccatgctgtatctgtacggtcccgagagacccggcctccctctggccttcgcccccgcggctgctctagctgcctcgggccgggccgagaccccgcagaagcctccctacagctacatcgcgctcatcgccatggcgatccaggacgcgcccgagcagagggtcacgctcaacggcatctaccagttcatcatggaccgcttccccttctaccacgacaaccggcagggctggcagaacagcatccgccacaacctctcgctcaacgactgcttcgtcaaggtgccccgcgagaaagggcggccgggcaagggcagctactggacgctggacccccgctgcctggacatgtttgagaacggcaactaccggcgccggaagaggaagcccaagccgggccccggggccccggaggccaagaggccccgcgccgagacgcaccagcgcagcgcggaggcgcagccggaggcggggagcggggcagggggctcgggccccgcaatctcccgcctgcaggcagcgcccgcgggcccctcgcccctcctggacggcccctctccgccggcgcccctccactggccggggaccgcgtccccgaacgaggacgctggtgacgctgcccagggcgcagcggccgtggcggtcggccaggcagcgcgcacaggggacggcccggggtcccctctgcgccccgcctcccgcagctctccgaagagctccgacaagtccaagagcttcagcatagacagcatcctggcgggaaagcagggccagaagccgccttcaggggacgaactcctagggggtgccaagcctgggcccggcggccgtctgggtgcctcgctcctggccgcctcctccagcctccgtccgcctttcaacgcttccctgatgctcgacccgcatgtccagggcggcttttaccagctcgggatccccttcctctcttatttccccctgcaggttcccgacacggtactccacttccagtaaagcaaacaatggcacggttcttctcccggcccagcctgagcctccgctgagcgaaaggccacagctcccaccggcggaggattttaaaatgatctttgcctgggtcggcctgtgggttcagggaagtgttaccaaccattgcgcgcaggtgggcgcgctcgcctgccttctccgaagcaaacttttcccagcaactgggagcagctacggagacttaaaagatccccgcggggtcgtgggcaccgcacgtgggccctgcagggacctccaccgcgggagattccttgacgtttgacctgtctaatggagtgtggtcttcagccgcccaccgcaggtcctgcgagtcccgggcatgcaagggcccgcagaccacccaaggcaggccttacaggtgcagttgaggtcctttcgaccggggacccccgtatgaccgtcgcctgcttcgctgttgccgtgtggctcaggccttggttttgagcccatctgggtggtgggtggtcacagctgggtttgttcctgacttgaagttgtggaggtgccgggggtgaccccgggttttcaggttttctgagagatgtagggcccgatgaggatttatgaccaatgttcagctatagaagctgataaccacccagagcaataacacttttattttaaacagagactttttctcttaatttctttctgggtagtaaaaagaacatgtttcattctttgcataaatacttgactctaagcattgacctttgaaaacgcttgtattaacaatttttattaagaaagtgcactctatataacatcttcttgcattacgatagctcattagccaatacacatgcagctatgtaagccacaacagcagacgtcctatccttttgcttttgtttttaagggatcaaaatatttcaagggataccatgaggaagggtgtgaggggaaggggatatgccttggacaatgtcagagttttgatttccatgttttttcaagatccaggcttggtggtcgctatatttttcagaaacagataatgaaagactacatttaatttaaaaagttgggtgaaacaaccaaaagcagatgcagagagagagagggatgaatgcgggggaagaataaggggacgtgctggtgtccgctggaaggggcctctctgggccccagaggacctgaggtttgatggcaggaatctcccagacactcctggcccccgcaccccctgcagccgcccgctcttccctcccagccctgccaggcaggcctggaggctgatactaaatcaaaaccttaaagaggtgactggcagtctggggaggggagaagaggtctgcaacgaaaatctaattaagaacattgagatgttcacaaccaagttcagcttgcagcttccggggaaatgcaaccgacctctatgccatctctagctgggtaatcttcgaggccctgaaatgcaattttctgaacctctaagtcacttttattttatgtcatgtgataaagacacaagtagtcacgcactattggaaataggttgggagggaggtctttaagatcgcttttaaaatagtttccaggacttgtctaaaaatgatgacaaactttgaatccagagggcctgttggtcaatgtgttggaaaggacatttcaggccggcagagtaattggataattcacaggcatagaggtgacttttggaaaattcattctcctatccatgctgaaccaggcttccacgactgggttctacccaggccagtgggaagactctgggaaacttcaggccagccttgattggaagaacttccaggaggagccattgctgagatccaggctcactgtgattcactgaaaatgtagcgaaagggctgtcactggatattttgctatcccaaactctcagcctctgtgaataaagttgttttttcattaacctctcaaaaaaaaaaaaaaaaaa

SEQ ID NO: 383 - DNA, 2548 bp, Human
agcaaagccgtcccagctggctttggggtaatgctggccttagttatgctgagcgatgcagccctcctgaggtcattcggaacgcccgggagagtggccactcccgccccagagggggaagggtggccggtttccaagtccgacttggtcaggtgaccgcggcgcggcatactcagcggcagagacggaagaacagcgctcccgaggccgcgggagcctgcagagaggacagccggcctgcgccgggacatgcggccccaggagctccccaggctcgcgttcccgttgctgctgttgctgttgctgctgctgccgccgccgccgtgccctgcccacagcgccacgcgcttcgaccccacctgggagtccctggacgcccgccagctgcccgcgtggtttgaccaggccaagttcggcatcttcatccactggggagtgttttccgtgcccagcttcggtagcgagtggttctggtggtattggcaaaaggaaaagataccgaagtatgtggaatttatgaaagataattaccctcctagtttcaaatatgaagattttggaccactatttacagcaaaattttttaatgccaaccagtgggcagatatttttcaggcctctggtgccaaatacattgtcttaacttccaaacatcatgaaggctttaccttgtgggggtcagaatattcgtggaactggaatgccatagatgaggggcccaagagggacattgtcaaggaacttgaggtagccattaggaacagaactgacctgcgttttggactgtactattccctttttgaatggtttcatccgctcttccttgaggatgaatccagttcattccataagcggcaatttccagtttctaagacattgccagagctctatgagttagtgaacaactatcagcctgaggttctgtggtcggatggtgacggaggagcaccggatcaatactggaacagcacaggcttcttggcctggttatataatgaaagcccagttcggggcacagtagtcaccaatgatcgttggggagctggtagcatctgtaagcatggtggcttctatacctgcagtgatcgttataacccaggacatcttttgccacataaatgggaaaactgcatgacaatagacaaactgtcctggggctataggagggaagctggaatctctgactatcttacaattgaagaattggtgaagcaacttgtagagacagtttcatgtggaggaaatcttttgatgaatattgggcccacactagatggcaccatttctgtagtttttgaggagcgactgaggcaaatggggtcctggctaaaagtcaatggagaagctatttatgaaacccatacctggcgatcccagaatgacactgtcaccccagatgtgtggtacacatccaagcctaaagaaaaattagtctatgccatttttcttaaatggcccacatcaggacagctgttccttggccatcccaaagctattctgggggcaacagaggtgaaactactgggccatggacagccacttaactggatttctttggagcaaaatggcattatggtagaactgccacagctaaccattcatcagatgccgtgtaaatggggctgggctctagccctgactaatgtgatctaaagtgcagcagagtggctgatgctgcaagttatgtctaaggctaggaactatcaggtgtctataattgtagcacatggagaaagcaaatgtaaaactggataagaaaattattttggcagttcagccctttccctttttcccactaaattttttcttaaattacccatgtaaccattttaactctccagtgcactttgccattaaagtctcttcacattgatttgtttccatgtgtgactcagaggtgagaattttttcacattatagtagcaaggaattggtggtattatggaccgaactgaaaattttatgttgaagccatatcccccatgattatatagttatgcatcacttaatatggggatattttctgggaaatgcattgctagtcaatttttttttgtgccaacatcatagagtgtatttacaaaatcctagatggcatagcctactacacacctaatgtgtatggtatagactgttgctcctaggctacagacatatacagcatgttactgaatactgtaggcaatagtaacagtggtatttgtatatcgaaacatatggaaacatagagaaggtacagtaaaaatactgtaaaataaatggtgcacctgtatagggcacttaccacgaatggagcttacaggactggaagttgctctgggtgagtcagtgagtgaatgtgaaggcctaggacattattgaacactgccagactttataaatactgtatgcttaggctacactacatttataaaaaaaagtttttctttcttcaattataaattaacataagtgtactgtaactttacaaacgttttaatttttaaaacctttttggctcttttgtaataacacttagcttaaaacataaactcattgtgcaaatgta

SEQ ID NO: 384 - DNA, 2561 bp, Human
gaggggaagatgcagcgagggagagacctagaaccgcgatcaaagctgcagcagctgctggggctggcggcacaaagggaggagggaggagcctgggcgctgagaaagttcttggggaaagttgagctgagccaagagtcgggcggtggctgggatgggcgggagggcccggcccgatttcccttgctgctccccttgtggcctgacgctgacagaggcaaaaatctgctaactcagggggcagactcaaccaagactgtgagcaggcctggggaatgaccccccgatctccaaccagtgccttccgcagctgcacggctgtctccagctgtctctgcccctcttcctggccctggctccatctctctgtcacctcacccttccctgtgccacatgggccctctctctcctgccaggacgctgcggctctggggacctcggagcctgggggtggctctgggagtcttcatgaccattggctttgcactccagctcttgggagggcccttccagaggaggctacctgggctacagctccgacagccctcggccccatccctacgaccagcccttccgtcctgcccaccccggcagcgactggtgttcctgaagacacataaatccgggagcagctctgtgctgagcctgcttcaccgctatggggaccagcacgggctgcgcttcgccctccctgcccgctaccagtttggctacccaaagctcttccaggcctctagggtaaaaggctaccgcccacagggtggaggcacccagctccccttccacatcctctgtcaccacatgaggttcaacctgaaagaggtacttcaggtcatgccttctgacagcttctttttttccattgtccgagacccagcggctctggctcgctctgccttctcctactataaatccacctcatcagccttccgcaagtcaccatctttggctgccttcctggccaatcctcgaggcttctacaggcctggggcccgtggggaccactacgctcgcaacttactatggtttgactttggcctgccctttcccccagagaagagggccaagagagggaatattcatccccccagagaccccaaccccccacagctgcaggtcttgccttctggtgctggccctcgagcccaaaccctcaatcccaatgccctcatccatcctgtttccactgttactgatcatcgcagccagatatcaagccctgcctctttcgatttggggtcttcatccttcatccagtggggtctggcatggctggactctgtctttgacctggtcatggtggctgagtacttcgatgagtcattggttctgctggcagatgccctgtgctggggtctagatgacgtggtgggcttcatgcacaatgcccaggctggacataagcagggcctcagcactgtcagcaacagtggactgactgcggaggaccggcagctgactgcacgggcccgagcctggaacaacctggactgggctctctatgtccacttcaaccgcagtctctgggcacggatagagaaatacggccagggccggctgcagacagctgtggccgagctccgggctcgccgagaggccctagcgaaacattgtctggtagggggtgaggcttctgaccccaaatacatcactgatcgccggttccgccccttccagtttgggtcagctaaggttttgggctatatacttcggagtggattgagcccccaagaccaagaggaatgtgagcgcctagctacccctgagctccagtacaaggacaagctggatgccaagcagttcccccctaccgtctcactgcccctcaagacttcaaggccactctccccataaacatcagactacagatttaggtggaagagcagccatgtttgaagggcacatgtgatgagtggggggcagcaagatgccatttctgcatctcccagaagggatgagtctttgtcccgatgcaagccccctcttcgctgggctcccagcagtgcttccctcctccaccctccactcattttgttctttccccccaactttttttttttttgaaacggagtcttgctctgtcccccaggctggagtgcagtggcatgatctcggctcactgcaacctctgcctcccaggttcaagcgattctcctgcctcagcctccagagtagctaggattacagatacgtgccaccatacccggctaatttttatatttttagagacagggattcaacatgttggttaggctggtcttgaactcctcacctcaggtgatccacatgactctgcctcccaaagtgctgccattacaggcgtgagccactaggcctgacctccccttcccctttcctgccccaaggcagatccacatcaccgaagctccctagaggggcaaaagatggagtgagccacaggaagtttggggcgtggtgagttggaatgatacgtccatttctctatgaaatatttgctactagactgttcatttctctctgacatgtttgttgaatgaataaataatttgaaacttctaaaaaaaaaaaaaaaaaaaaaa

SEQ ID NO: 385 - DNA, 3171 bp, Human
gttccgcaccggaagcgcgcttccagtcgccccggcaacagccgcctccctcgcgtcccccactccccctctgtctctccaaggaaaactaggcccctgcgcggccaacgcccaggatccgcaagctgcgcgcccacgagctccaccagcccattggagaaaagttactgttcagtccctgaaggcttgtgccataaaagagtgggagacattcccagggagtttcagcacccatttggactttcacaatcagagatggcagcggtaaaggcatcaacatcgaaagctaccaggccttggtattctcatccggtatatgcaagatactggcaacattatcatcaagcaatggcttggatgcaaagccatcacaatgcctacaggaaggccgtggaatcctgtttcaatcttccatggtacttaccttctgcgcttcttccccaaagctcttacgataatgaggctgcgtatcctcagtccttctatgaccatcatgtggcctggcaggactacccctgcagttcttcacatttcagaagatctgggcagcatccacgttacagcagtaggatccaggcatccacaaaagaagaccaagctttgtccaaagaggaagagatggagactgagtcagatgcagaggtagaatgtgacctgagcaatatggaaatcactgaagagctccgccagtactttgcagagaccgagaggcatagagaagaacgacggcggcagcagcagctggatgcagagcgcctggacagctatgtgaacgctgaccacgacctgtactgcaacacccgccggtcggtagaagccccaactgagaggcctggtgagcggcgccaggccgagatgaagcgtttgtacggggacagtgctgccaagatccaagccatggaggccgcggtgcagctgagctttgacaagcactgtgaccgaaagcagcccaagtactggccggtcatccccctgaagttctgagctcagggcacagggtacccagcctctccttcttccttttgggtacacgctctttatctctccttctgtacatttcttagggaaaggggactttgtactggggtacaggcatgttcaccacagtcccagtgggcctgtcacggggtggatgtactatgccagccacttggaggtctgcaggacatgttctgttgccaacatgataaattttctcctgacataaaataattttgcatatactatactggttttttatgttgttggtaacagttcaattcattaacgttcttgcctagagatactgcctggtgttttgcttttttatcttttcttgtctttaacctgtctgaactacacaaatgcctttaaaaaaccagatatcctctctgactctagctccattagcccccactaaaaatgagccaagtgtgtagtgagacaaataccactacctgtagtggagagggatgcatgttctataaagggccagagagtgaatatctttggcactgcaagccacacggtcagtgttgtgactactcaaccctccctttgtagtgtgaaagcagctgtagacagtaagtaaacaaatgggtgtggctgtgttctaataaaactttatttataaaaacaggcggccgggcgcaatggttcatgcctgtaatcccagcactttgggaggccgaggtgggcagatcacgaggtcaggagatggagaccatcctggccaacatgatgaaacccgtcgctactaaaatacaaaaaatgagccgggcatggtggtgtgtgcctgtaatcccagctacgtgggagactgaggcaggggaattgcttgaacccaggaggcagaggttgcagtgagctgagatcgcgccactgcactccaacctagagaaagagcaagactccgtctcaaaacaaaaacaaaaacagactgcaggccagatttggtctacagatggtagtttgccaactgcacctctcatggaatgaaaatcacctgcctgacatttttattcttgttatctcattatgtctacagagcttagatgtcatacagaattgagagcaaagaacaataattccggcccggcgcggtggctcatgcctgtaatcccagcactttgggaggctgaggtgggcagatcacgagatcaggagatcgagaccatcctggctaacacggtgaaaccccatctctactaaaaatacaaaaaattagccgggcgtggtggcgggcacctgtagtcccagctacttgggaggctgaggcaggagaatggcgtgaacccaggaggcggagcttgcagtgagccgagctccagcctgggcaacagagtgagactccatctcaaaagaaaaaaaaaaaagaacaataattcccaaacctggtcactgctgcagtcacctctgttgcagaaaacgcacagttgatttcttactatatacagcaaatattgatttgataaaggaatacatttctgaaaatgaaatctaaaagctgatggagcaggtcatttataaaagccagctgccttttaaataagttattacagtacattgccagggtgagcccatgttgacctgagaagattagcacatccatcaaaggctggtgaaaagatttagtattgacatgtttctctctaagaacagttggcttcacattcagcccctgccctgagacaaatgcattattttcatcagccctgggtgcttatttttctaagctctcattttattactggagtcacaatttgtgtgtaggtgttgccgacaaaaatgataattaactttcccttgaggtgacacataactaaaatttcaaatctttagtatttctccctttcattttaaattcatatgcctaactataaaataactgtgactgagatacaagtacaaaccaaagcctggaattgcagcaggtgctgaggcatttgaaagtgaaatgtttctcttcgcaaaggactcttataccctcccctaaagaaatcaccatgccggtctcacccctactggctttgttacctaaggcttcacctctcagtgcttctggttccttccttatccttaaaatgagtgttaataattctctcgtggggtcattgtgcggaccacattgagtagtgcctgtaaaacagtgctggctacacggtaaatactcaataaatgttgacacgttta

SEQ ID NO: 386 - DNA, 1863 bp, Human
agtgacgtcacggcccgtggcgcccttcgtggactgggctgtacggtgcgcgtgacggctgcgtgcggcgggaatcatggctgctcgcagagctctgcacttcgtattcaaagtgggaaaccgcttccagacggcgcgtttctatcgggacgtcctggggatgaaggttctgcggcatgaggaatttgaagaaggctgcaaagctgcctgtaatgggccttatgatgggaaatggagtaaaacaatggtgggatttgggcctgaggatgatcattttgtcgcagaactgacttacaattatggcgtcggagactacaagcttggcaatgactttatgggaatcacgctcgcttctagccaggctgtcagcaacgccaggaagctggagtggccactgacggaagttgcagaaggtgtttttgaaaccgaggccccgggaggatataagttctatttgcagaatcgcagtctgcctcagtcagatcctgtattaaaagtaactctagcagtgtctgatcttcaaaagtccttgaactactggtgtaatctactgggaatgaaaatttatgaaaaagatgaagaaaagcaaagggctttgctgggctatgctgataaccagtgtaagctggagctacagggcgtcaagggtggggtggaccatgcagcagcttttggaagaattgccttctcttgcccccagaaagagttgccagacttagaagacttgatgaaaagggagaaccagaagattctgactcccctggtgagcctggacaccccagggaaagcaacagtacaggtggtcattctggccgaccctgacggacatgaaatttgctttgtcggggatgaagcatttcgagaactttctaagatggatccagagggaagcaaattgttggatgatgcaatggcagcagataaaagtgacgagtggtttgccaaacacaataaacccaaagcttcaggttaacggaagacatgatgcagagcaagcctctgtgattcctgcccagcacctgtgaggcctgacgtgtcagttcccaataaatgctcttctgatttgtttcccgtacaggcaaggaggcttgggtagtgcagatttgtgtatttcaatctttgaaagctctgatgtaatttagaaatgaaatccaatcatgagtccaggtagagaacgcctgctgtaatctacactgttgctgggactgcgcattctgtatataactgtgttggatgagtgacagatgattgtccagactaggacagcggcatgaacatgactttggttgggattgcggatagttagggttacctctgaatcgtgtagcttttatgagagcagctgtgcaagtgaatccacattaatgccttgtcgtggtgccattcccagcgcctgacgatacgctcttctattgtcttattctggcaggttttgacgttttaaattttttaaagaaattttattccttggaccaaaaggtttggttaaccacccccctcttacttgctttcacattttgagtgtccagaggaaacagaaaggaatgagtgtgtgacgttgctgcacgcctgactctgtgcgagcttctttctgtgtatatattttgttttatttttttccgtgtatatttttaatcccgacagaacatcatgtgagatttctttaaaatggattaaacgatttcttcagcctgaaaaaaaaggttttgaaaatgttttcttgtagttttgtttggttctaaacaacaaataggttttaatcactcgaaatggaattatattgtgtattcattgaataaattttttttgaaagtaagcttctgaaatcaagctgtgaaaaaaaaaaaaaaaaaaaaaaaaaaa

SEQ ID NO: 387 - DNA, 2719 bp, Human
acttaaggtcggcgacccgaggccgcggctgccgactgggtcccctgccgctgtcgccaccatggctccgcaccgccccgcgcccgcgctgctttgcgcgctgtccctggcgctgtgcgcgctgtcgctgcccgtccgcgcggccactgcgtcgcggggggcgtcccaggcgggggcgccccaggggcgggtgcccgaggcgcggcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtgaaaaaaaaaaaaaaaaaaaaaaaaaaaaaaaaaaaaaaaaaaaaaaaaaaaaaaaaaaaaaaaaaaaaaa

SEQ ID NO: 388 - DNA, 5450 bp, Human
attggctgtgggagccaccgtcccgcctcccagcgactctcggcggtgccggagtcgggtgggttggcggctataaagctggtggcgaaggggaggcgccgcggactgtcctttcgtggctcactccctttcctctgctgccgctcggtcacgcttgtgcccgaaggaggaaacagtgacagacctggagactgcagttctctatccttcacacagctctttcaccatgcctggatcacttcctttgaatgcagaagcttgctggccaaaagatgtgggaattgttgcccttgagatctattttccttctcaatatgttgatcaagcagagttggaaaaatatgatggtgtagatgctggaaagtataccattggcttgggccaggccaagatgggcttctgcacagatagagaagatattaactctctttgcatgactgtggttcagaatcttatggagagaaataacctttcctatgattgcattgggcggctggaagttggaacagagacaatcatcgacaaatcaaagtctgtgaagactaatttgatgcagctgtttgaagagtctgggaatacagatatagaaggaatcgacacaactaatgcatgctatggaggcacagctgctgtcttcaatgctgttaactggattgagtccagctcttgggatggacggtatgccctggtagttgcaggagatattgctgtatatgccacaggaaatgctagacctacaggtggagttggagcagtagctctgctaattgggccaaatgctcctttaatttttgaacgagggcttcgtgggacacatatgcaacatgcctatgatttttacaagcctgatatgctatctgaatatcctatagtagatggaaaactctccatacagtgctacctcagtgcattagaccgctgctattctgtctactgcaaaaagatccatgcccagtggcagaaagagggaaatgataaagattttaccttgaatgattttggcttcatgatctttcactcaccatattgtaaactggttcagaaatctctagctcggatgttgctgaatgacttccttaatgaccagaatagagataaaaatagtatctatagtggcctggaagcctttggggatgttaaattagaagacacctactttgatagagatgtggagaaggcatttatgaaggctagctctgaactcttcagtcagaaaacaaaggcatctttacttgtatcaaatcaaaatggaaatatgtacacatcttcagtatatggttcccttgcatctgttctagcacagtactcacctcagcaattagcagggaagagaattggagtgttttcttatggttctggtttggctgccactctgtactctcttaaagtcacacaagatgctacaccggggtctgctcttgataaaataacagcaagtttatgtgatcttaaatcaaggcttgattcaagaactggtgtggcaccagatgtcttcgctgaaaacatgaagctcagagaggacacccatcatttggtcaactatattccccagggttcaatagattcactctttgaaggaacgtggtacttagttagggtggatgaaaagcacagaagaacttacgctcggcgtcccactccaaatgatgacactttggatgaaggagtaggacttgtgcattcaaacatagcaactgagcatattccaagccctgccaagaaagtaccaagactccctgccacagcagcagaacctgaagcagctgtcattagtaatggggaacattaagatactctgtgaggtgcaagacttcagggtggggtgggcatggggtgggggtatgggaacagttggaggaatgggatatctggggataattttaaaggattacatgttatgtaaatttttatgtgactgacatggagcctggatgactatcgtgtacttgggaaagtctctttgctctatttgctgacatgcttcctgttgtggtctggccaatgccaaatgtactcgaatgatgttaagggctctgtaaaacttcatacctctttggccatttgtatgcatgatgtttggtttttaaacatggtataatgaattgtgtacttctgtcagaagaaagcagaggtactaatctccaattaaaaaattttttaacatgtaagaattttgtactttgaacaacaagattacagaaagtacctgtggtttttggaaaacatttctagcttggggaatgtgacaacattccccagtgtggtaaaattggggtaaaatgtggtaaaatgtgatacgcacaaaccctttgaaaatagcaaaacaaacatgccctttttctaaaattgataaatcctaaagaggaagaaaagagctgggacaataaaacactggctctggaatctggaatgttaagtccaggccagcagtgacaaaagttattgtaatgacctctgaacagagaaacactgccattgaagaggcttctggtatagaaaacatggtacattcaggagctgtgaatatagctctaggtgtgctcctgaatcagttcatggtagattatgctgaacaacagtgagatgttattggaggtgtggatgagggagtttgttgttgcagtccttctttgcaccttattttaaagaataaatgaaacatttttctggttacttttttaaaaatttaaaatggaagggaagaataggggcagggcattattaggctatttctgatgcttcagtgttataaattcaacatagaggctgacaacctaaattcatggtgtaacacagctcttttccttttccttttttttttttttttggtatctgttcaatgaaaataaggtatgacccaagtttttacctagtctgactagaagtattccacttcaaggtctgaagtaggacttttaccttaaaaaacaacaacaaacaaaactatcacacaggatagataagaagattggttaaacagttttgtgtagatctttttggtgctgaactatgacatgagccttatagattgtaaaatagggatagttggaactaatgtacagaactaaattttttaaactttatttgctgttaaattctgtgaagtttcagttatctaaaataaatatacacaaatatgaaatataatgtttcagattgcaaggtaatatgtaatagtagtgtttgtaagatactcttgtctaatattaactagtagtattttgatttgtacagtcataatttgttaaaatgacttcatttaacattcactgatgtagattaataatgtaagttctgatttaaagaatggtggcaaaatggtgcatgtaatacttttgcaagtgttggggagatcggtatgttttgaaaagagtaatttaacttttgggtgccaggaaatgggttttctcaaagtccattgccggcaatgggcaggcctgcaaatactggcacagagcattaatcatacaccttattaacggtgaggtgaataactttgaaataaagttttagagaaatgtttcagatacttgagtattctttttcactcttgaactaacaacttcggcaagaaatcagctaatattctatttttaaatatgggcattaatttcatttcagttcgttcactcattccattcatttatcatttcacaaacatttgaaatcctaatataagcaaggtgctctgtttaaggcagaaatttgaaaatgtacaagatatatggtcttgtctttaaggagctgttcatctagaatggaggaatttacactgataattattcctacacttgaaacaaagaaattaactctcaaattgcgtggcaagcatatatagactttgctataaatatttatgaaatgagttactgttttccttaaaaaagctaagactaagggctggcaatcaaataagagcaaatttagtggtgaacgtagaactgcccactaccagctagagtctccaacctaaaagtcccatgttgctagtgatccccaggggttttatagaaggaatccctgcattggcagtaattttggattagatgatccctaagagcaccatcaagtcttaggattctatgaattaggaaataaaccaaattatatattttctaatactgatcagctcatattttatcatcatgtcatgtctggctttcatacttagtcataatttactttctgggtcatttagaggctagcgttctctaaggtcacttctgcttgcacattgtaggatattatttagtatggctttaagaattcaatctttccccctctcctttatggaatgtgtgtttcctctatttgtacacttaaccttttgtcctaagtttttatttttatggatactaatgagtaactttgaggttgacactagacccaaacagatgcaaacagccactttctgtcctcttgtgacacagttgaaacactttatctcttgtctgctgtttggagtgtcctgaaagaaacactgaagtggcagtcaacagagcaagggtaacaggatctttaaataatttaaagttgtctgatcttgacataaaagtgaaccctttctttaaaatttctagcaactgctcttaagtcataggttcctcattttttctttgctggtagtgggagaaaatagttgatctgtgatttttgttttcatctccccaaactatgttataaaggcagtaatttgatgctgaagattatgattagaaatcctcagatgggttatatattggggctttatcttttaatattaaaaagaatgtctttcctggactactttattcagtagtaagcactattcattctatgtatattccttattcagccttgcagactcctgtgggatctgatctcttcctgcttcaactcagtaccatactcaccaaggcttagtatgtcttcacccactctcccttctcttgcattcctcaaacatgctgagtttattccagccttaagcctttgatctacgcatcagaaatgttgggccccacttcagatcttctctgccctgccttctactccagtcactgctgtggtaactaattccatgaagtctttgaccaggttctcagagaatatgatagtacctctctttggattctagctgtatacctttcacttcagcctccctgacgtggaatgtctgcagaacttgtttggtactcccaattgcacagcccaaaggtgcaggggagttaggtgcccatggggccatccttgacctaggtggaaagttgctagtggataactgattactcttttcatcacctgggcagacagttctgaaatgcatttcgtaagtctcctcaaaagaggaggagacttctgtggcgggtttggcaataaccatccttatattggctttcctcttttgtttcactcctgtgcatctctcttgcatcctgggatcgcttctcaaataaatgactttcattcaa

SEQ ID NO: 389 - DNA, 3887 bp, Human
gactgcgcaggcgtgctcacctggcgtgctccacccgactgggcgtccgcaggctcctcccccgggtgtggcctccgggcggcatggctgcttcccaggtgatgccggcttcagctagtggggtctagttgaccgttccgcagccgccagggccagcggaaagccggtcagggggaaccgcggcggggctggtgtcatgagcctgaggtgaacttgagggtgcctcctcagcggtctcccgccctgccctgaggggcgccgggaccccaaagagcggaggaagagcgccaccccgacggccaccgcttcggagccagcacgcggggtaccctacggggagcgcggatgcccccgtgttcgggcggggacggctccacccctcctgggccctcccttcgggacagggactgtcccgcccagagtgctgaatacccgcgcgaccgtctggatccccgcccaggaagcccctctgaagcctcctcgccgccgtttctgagaagcagggcacctgttaactggtaccaagaaaaggcccaagtgtttctctggcatctgatggtgtctggatccaccactctactctgtctctggaaacagcccttccacgtctctgcattccctgtcaccgcgtcactggccttcagacagagccaaggtgcagggcaacacctctacaaggatctgcagccatttatattgcttaggctactgatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaattcatcagatgcattggacaaaatccggtatgaaagcttgacagatcccagtaaattagactctgggaaagagctgcatattaaccttataccgaacaaacaagatcgaactctcactattgtggatactggaattggaatgaccaaggctgacttgatcaataaccttggtactatcgccaagtctgggaccaaagcgttcatggaagctttgcaggctggtgcagatatctctatgattggccagttcggtgttggtttttattctgcttatttggttgctgagaaagtaactgtgatcaccaaacataacgatgatgagcagtacgcttgggagtcctcagcagggggatcattcacagtgaggacagacacaggtgaacctatgggtcgtggaacaaaagttatcctacacctgaaagaagaccaaactgagtacttggaggaacgaagaataaaggagattgtgaagaaacattctcagtttattggatatcccattactctttttgtggagaaggaacgtgataaagaagtaagcgatgatgaggctgaagaaaaggaagacaaagaagaagaaaaagaaaaagaagagaaagagtcggaagacaaacctgaaattgaagatgttggttctgatgaggaagaagaaaagaaggatggtgacaagaagaagaagaagaagattaaggaaaagtacatcgatcaagaagagctcaacaaaacaaagcccatctggaccagaaatcccgacgatattactaatgaggagtacggagaattctataagagcttgaccaatgactgggaagatcacttggcagtgaagcatttttcagttgaaggacagttggaattcagagcccttctatttgtcccacgacgtgctccttttgatctgtttgaaaacagaaagaaaaagaacaacatcaaattgtatgtacgcagagttttcatcatggataactgtgaggagctaatccctgaatatctgaacttcattagaggggtggtagactcggaggatctccctctaaacatatcccgtgagatgttgcaacaaagcaaaattttgaaagttatcaggaagaatttggtcaaaaaatgcttagaactctttactgaactggcggaagataaagagaactacaagaaattctatgagcagttctctaaaaacataaagcttggaatacacgaagactctcaaaatcggaagaagctttcagagctgttaaggtactacacatctgcctctggtgatgagatggtttctctcaaggactactgcaccagaatgaaggagaaccagaaacatatctattatatcacaggtgagaccaaggaccaggtagctaactcagcctttgtggaacgtcttcggaaacatggcttagaagtgatctatatgattgagcccattgatgagtactgtgtccaacagctgaaggaatttgaggggaagactttagtgtcagtcaccaaagaaggcctggaacttccagaggatgaagaagagaaaaagaagcaggaagagaaaaaaacaaagtttgagaacctctgcaaaatcatgaaagacatattggagaaaaaagttgaaaaggtggttgtgtcaaaccgattggtgacatctccatgctgtattgtcacaagcacatatggctggacagcaaacatggagagaatcatgaaagctcaagccctaagagacaactcaacaatgggttacatggcagcaaagaaacacctggagataaaccctgaccattccattattgagaccttaaggcaaaaggcagaggctgataagaacgacaagtctgtgaaggatctggtcatcttgctttatgaaactgcgctcctgtcttctggcttcagtctggaagatccccagacacatgctaacaggatctacaggatgatcaaacttggtctgggtattgatgaagatgaccctactgctgatgataccagtgctgctgtaactgaagaaatgccaccccttgaaggagatgacgacacatcacgcatggaagaagtagactaatctctggctgagggatgacttacctgttcagtactctacaattcctctgataatatattttcaaggatgtttttctttatttttgttaatattaaaaagtctgtatggcatgacaactactttaaggggaagataagatttctgtctactaagtgatgctgtgataccttaggcactaaagcagagctagtaatgctttttgagtttcatgttggtttattttcacagattggggtaacgtgcactgtaagacgtatgtaacatgatgttaactttgtggtctaaagtgtttagctgtcaagccggatgcctaagtagaccaaatcttgttattgaagtgttctgagctgtatcttgatgtttagaaaagtattcgttacatcttgtaggatctactttttgaacttttcattccctgtagttgacaattctgcatgtactagtcctctagaaataggttaaactgaagcaacttgatggaaggatctctccacagggcttgttttccaaagaaaagtattgtttggaggagcaaagttaaaagcctacctaagcatatcgtaaagctgttcaaaaataactcagacccagtcttgtggatggaaatgtagtgctcgagtcacattctgcttaaagttgtaacaaatacagatgagttaaaagatattgtgtgacagtgtcttatttagggggaaaggggagtatctggatgacagttagtgccaaaatgtaaaacatgaggcgctagcaggagatggttaaacactagctgctccaagggttgacatggtcttcccagcatgtactcagcaggtgtggggtggagcacacgtaggcacagaaaacaggaatgcagacaacatgcatcccctgcgtccatgagttacatgtgttctcttagtgtccacgttgttttgatgttattcatggaataccttctgtgttaaatacagtcacttaattccttggccttaaaa

SEQ ID NO: 390 - DNA, 4469 bp, Human
aaatgtagtcactgtcccggaacctggggcagcggagtcccgtgcgccctgtggtgacagctcaggagggtgtgtgcgctcagcaggggccagcatggaccagtctgtggcaatccaggagacgctggctgagggggaatactgcgtcatcgcggtgcaaggtgtgctgtgtgagggggacagccggcagagccgcctcctgggactcgtgcgctaccgcctggagcacggcggccaggaacacgctctcttcctctatacgcaccggaggatggccattaccggggacgatgtctctctggaccagatagtgccagtctcgcgggattttacgctggaagaagtgtccccagatggtgaactctacatccttggctcagatgtgaccgtccagctggacacagcagagcttagcctcgtattccaactgccctttggttcacaaaccaggatgttcctccacgaagttgccagggcctgtccaggcttcgattctgcgacccgggatcctgaattcctgtggctgtctcggtataggtgcgcagagctggagctggagatgccaacgccgcgcggttgtaactcggccctagttacctggccagggtacgcgacaattggcggaggtggttctaactttgatggtttgagaccaaatgggaagggagtgcctatggaccaaagctccaggggtcaagataaaccagaaagcttgcaaccaagacagaataaatccaagtccgaaattactgacatggttcgctcctccactatcacagtgtcggacaaggctcatattttatccatgcagaagtttggactgcgagatacaattgtgaaatcacatctactacagaaagaagaggattacacctatatccagaacttcaggttttttgcgggaacatacaatgtaaatgggcagtcccccaaagaatgcctccggctgtggctgagcaatggtatccaggccccagatgtctattgtgtagggttccaggagcttgatctgagtaaggaagcttttttctttcacgataccccaaaggaggaagagtggttcaaagctgtgtcagagggtcttcatccagatgccaaatatgcaaaggtgaagcttatccgactggttgggattatgctgctgttatatgtcaaacaggagcatgcagcttatatctcagaagtggaagccgagactgtggggacaggaatcatggggaggatgggcaacaagggaggcgtggcgatcaggttccagttccacaacaccagcatctgcgttgtgaattctcacttggcagcccacattgaagagtatgagaggaggaaccaggactataaggacatttgttctcgaatgcagttttgtcagcctgacccaagccttccccctctcaccatcagcaaccatgatgtgatcttgtggctgggggacctcaactacaggatagaagagctggatgtggaaaaagtgaaaaagctcatcgaagagaaggactttcaaatgctgtatgcatatgatcagctgaaaattcaggtggccgcaaagactgtctttgaaggcttcacagagggtgagctcacattccagcctacttacaagtatgatacgggctctgacgactgggataccagtgagaagtgccgtgctcctgcctggtgtgatcggattctctggaaagggaagaacatcactcagctgagttaccagagccacatggccctgaagaccagtgaccacaagcctgtcagctcagtgtttgacatcggggtgagggtcgtaaatgacgagctttaccggaagacactggaggaaattgttcgctccctggataagatggaaaatgccaacattccttctgtgtccctgtccaagcgagagttctgttttcagaatgtgaagtacatgcaattgaaagtagaatcctttacaattcataatggacaagtaccctgtcattttgaattcatcaacaagcctgatgaagagtcttactgtaagcagtggctgaatgccaaccccagcagaggcttcctcctgccagattctgatgttgagattgacttggagctcttcgtaaataagatgacagctacaaagctcaactcgggtgaagacaaaattgaggacattctggttctgcacttggacaggggaaaggattactttttgtctgtgtctgggaactacctgcccagctgttttgggtctcccattcatacactgtgttacatgagagagccaatcttggacctaccacttgaaaccattagtgagctgactctgatgccagtatggactggagatgatgggagccagttggatagccccatggaaatccccaaagagctctggatgatggttgattacctgtaccgaaatgctgtccagcaggaagatctgtttcagcaaccaggcctgaggtcagaatttgaacatatcagggactgcttggatactggaatgattgataacctctctgccagcaatcattctgtagccgaagccctgctgcttttcctggagagccttccagagcctgtcatctgttacagcacctaccataactgcttggagtgttctggcaactacacagcaagcaaacaggtcatttctactctccccatattccacaaaaatgtcttccactacttgatggcgtttttgcgagaactgctgaaaaattcagcaaaaaatcatttggatgagaatattctagctagcatatttggcagcttattgcttcgaaacccagctggtcaccaaaagcttgatatgacagagaagaagaaggctcaagaatttattcaccagttcctctgcaacccactctgagcctctctctcctcctattttacttgaggctgccaattaccagccccacctgtttcagctcaagagatgccttaagataattatgtgaggccacttggtagcaagaatggcagctatttcctgagcctagtaccccaattaagcccaccattggttagcacactcagcgctgtgagtcgtgaagacacgggagaaaatccaccataataaaactgacattcaattttcaactttagttatttaacacagatttttttattttttatttttttttattttgagacggagttttgctctgtcgcgcagggtggagtgcggtggcacgatctcggctcactgcaacctctgcctcctgggtgcaagcaattatcctgcctcagcctcccgagtagctgggactgcaggcacacactgccacgcccagctaattttttgcattttagtagagacggggtttcaccgtgttgcccaggctgttctaaaactcctgaactcaggtaatctgcctgcctcggcctccccaagtgctaggattacagatgtgagccaccacgcccggccttttttttttttttttcttttttgagatggagtttcactcttgttgcccaggctggagtgcgttggcgtggtcttggctcactgcaacctctgcctccttggttcaagcaattctcctgcctcagcctctcgagtagctgggattataggcgtccgccaccatgcctggctaatttttttgtgtgtttttagtatagacacggtttcaccatgttggccaggctggtctcgaatgcctggcctcaggtgatccacctgccttggcctcccaaagtgctgggattacaggcatgaaccaccacgcctggcctaaaatgtttttaaataactgtacttgtactcactcaccctacctccagggcatagtcagtctgggctgagatccccatgatcagatatttgatggaaagtcctgaaaggccaatgagttggatggcaagaatgcaggcagaagctgctggataaaataggctacagccacctcagatgctttcagtgctctgtctgaggatgtgtatatgcatatgcaaactcgacccccgttcctgcccagataatggctcaataactctgaggctggttgctcagcctctgagggcaatacaggcatttaaaaaattaaaatgaccaggcacagtggctcacgcctgtaatctcggcactttgggagactgaggtgggagcatcacttgagaccaggagtttgggaccaggctgggcaacacagggagaccccctctctacaaaaacatttttaaaaaattagctgggtgtggtgatgcatgcctgtggtcccagttacttgggaggctgacgtgggtggctcacttgagcacaggagtttgaggctgcagtgacctatgaccacatcactgtacgccagcccgggtgagagagggagaccccgtctctaaaaataaaatgtaaaatcactgaaaaaatgagtgttcggtgaaacaagtgggattttctgggccagcaagtcttccaaactgtatatgatgcatcctgtctccatgtgtaatatattttaatgataaatgtatttttaacagtgaaaaaaaaaaaaaaa

SEQ ID NO: 391 - DNA, 3499 bp, Human
cgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggtcccaagccctgcttccctgtggcctccaccgccatctccagccccttcttctaccaagccaggcccagagagctcagtgtccctcctgcagggagcccgcccctttccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtagtgctagagaccttggctggtcagagggctgtgaagacgcacggtgccaggaccaagtatctgaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaataaaaaaaaaaaaaaaaaa

SEQ ID NO: 392 - DNA, 1189 bp, Human
agcttcggtgacgtcagagaggcgcgctcccagctcggagccgactcgcagacgcgccccgcccctcggcgtcgctctggactggcgcaggcgcaagccggcaagatggcggcggctggggctttccgtctgaggcgggcggcatcggctctgctgctgcggagcccccgcctgcccgcccgggagctgtcggccccggcccgactctatcacaagaaggtatctcaaatctgtgaagtattgtagaggagacacaaaaggaattgggggtcacaaatggttctcattgacatgagtgtagacctttctactcaggttgttgatcattatgaaaatcctagaaacgtggggtcccttgacaagacatctaaaaatgttggaactggactggtgggggctccagcatgtggtgacgtaatgaaattacagattcaagtggatgaaaaggggaagattgtggatgctaggtttaaaacatttggctgtggttccgcaattgcctccagctcattagccactgaatgggtgaaaggaaagacggtggaggaagccttgactatcaaaaacacagatatcgccaaggagctctgccttcctcccgtgaaactgcactgctccatgctggctgaagatgcaatcaaggccgccctggctgattacaaattgaaacaagaacccaaaaaaggagaggcagagaagaaatgagccctccctcggcgaagcctccagcaggccacaccagctgtttcccacctgctgtgcagtcaccttagatgttcagaagccgcttcctctccactgaagagctatgagatacgcacaatacttgctgttcacgttatgactctcatgcaagcaaaatacacagtttcattgttctgaatcctgtggtttctttcagcccacttttatcgccttaacctagttaatgtatattttgaattgtgtgtatgacctcagaactgaaattgataatgaagttgcaagttttgatagcccgtgaagtgcataagtatctaattttacctgaattgatttggggggaaattaccagtagaatgccttggtctgaatatttgatagaaccaattgttgtacataaaacagattgcgcatatatatatatgtataaaaaataataaaataatggaagatgatggtgttctctagtaaaaaaaaaaaaaaaaaa

SEQ ID NO: 393 - DNA, 4868 bp, Human
agttagcgcctgctgggtgtctgctcgggtggtctgggaactacaattcccggcgggctgtgagatgccttggctgtagttagtaaggagccggatgattgcctcagcaggtgtgaagcgtgtgctttagtttcgtgggaggcctggcatccccgagagggaggggaaaggtaaccactcctttgtggaggtcgccagggtcattgtcgtggatttgcacagtcggctgggcggtgcaatggcggaaagaaaaggaacagccaaagtggactttttgaagaagattgagaaagaaatccaacagaaatgggatactgagagagtgtttgaggtcaatgcatctaatttagagaaacagaccagcaagggcaagtattttgtaaccttcccatatccatatatgaatggacgccttcatttgggacacacgttttctttatccaaatgtgagtttgctgtagggtaccagcgattgaaaggaaaatgttgtctgtttccctttggcctgcactgtactggaatgcctattaaggcatgtgctgataagttgaaaagagaaatagagctgtatggttgcccccctgattttccagatgaagaagaggaagaggaagaaaccagtgttaaaacagaagatataataattaaggataaagctaaaggaaaaaagagtaaagctgctgctaaagctggatcttctaaataccagtggggcattatgaaatcccttggcctgtctgatgaagagatagtaaaattttctgaagcagaacattggcttgattatttcccgccactggctattcaggatttaaaaagaatgggtttgaaggtagactggcgtcgttccttcatcaccactgatgttaatccttactatgattcatttgtcagatggcaatttttaacattaagagaaagaaacaaaattaaatttgggaagcggtatacaatttactctccgaaagatggacagccttgcatggatcatgatagacaaactggagagggtgttggacctcaggaatatactttactcaaattgaaggtgcttgagccatacccatctaaattaagtggcctgaaaggtaaaaatattttcttggtggctgctactctcagacctgagaccatgtttgggcagacaaattgttgggttcgtcctgatatgaagtacattggatttgagacggtgaatggtgatatattcatctgtacccaaaaagcagccaggaatatgtcataccagggctttaccaaagacaatggcgtggtgcctgttgttaaggaattaatgggggaggaaattcttggtgcatcactttctgcacctttaacatcatacaaggtgatctatgttctcccaatgctaactattaaggaggataaaggcactggtgtggttacaagtgttccttccgactcccctgatgatattgctgccctcagagacttgaagaaaaagcaagccttacgagcaaaatatggaattagagatgacatggtcttgccatttgagccggtgccagtcattgaaatcccaggttttggaaatctttctgctgtaaccatttgtgatgagttgaaaattcagagccagaatgaccgggaaaaacttgcagaagcaaaggagaagatatatctaaaaggattttatgagggtatcatgttggtggatggatttaaaggacagaaggttcaagatgtaaagaagactattcagaaaaagatgattgacgctggagatgcacttatttacatggaaccagagaaacaagtgatgtccaggtcgtcagatgaatgtgttgtggctctgtgtgaccagtggtacttggattatggagaagagaattggaagaaacagacatctcagtgcttgaagaacctggaaacattctgtgaggagaccaggaggaattttgaagccaccttaggttggctacaagaacatgcttgctcaagaacttatggtctaggcactcacctgccttgggatgagcagtggctgattgaatcactttctgactccactatttacatggcattttacacagttgcacacctattgcaggggggtaacttgcatggacaggcagagtctccgctgggcattagaccgcaacagatgaccaaggaagtttgggattatgttttcttcaaggaggctccatttcctaagactcagattgcaaaggaaaaattagatcagttaaagcaggagtttgaattctggtatcctgttgatcttcgcgtctctggcaaggatcttgttccaaatcatctttcatattacctttataatcatgtggctatgtggccggaacaaagtgacaaatggcctacagctgtgagagcaaatggacatctcctcctgaactctgagaagatgtcaaaatccacaggcaacttcctcactttgacccaagctattgacaaattttcagcagatggaatgcgtttggctctggctgatgctggtgacactgtagaagatgccaactttgtggaagccatggcagatgcaggtattctccgtctgtacacctgggtagagtgggtgaaagaaatggttgccaactgggacagcctaagaagtggtcctgccagcactttcaatgatagagtttttgccagtgaattgaatgcaggaattataaaaacagatcaaaactatgaaaagatgatgtttaaagaagctttgaaaacagggttttttgagtttcaggccgcaaaagataagtaccgtgaattggctgtggaagggatgcacagagaacttgtgttccggtttattgaagttcagacacttctcctcgctccattctgtccacatttgtgtgagcacatctggacactcctgggaaagcctgactcaattatgaatgcttcatggcctgtggcaggtcctgttaatgaagttttaatacactcctcacagtatcttatggaagtaacacatgaccttagactacgactcaagaactatatgatgccagctaaagggaagaagactgacaaacaacccctgcagaagccctcacattgcaccatctatgtggcaaagaactatccaccttggcaacataccaccctgtctgttctacgtaaacactttgaggccaataacggaaaactgcctgacaacaaagtcattgctagtgaactaggcagtatgccagaactgaagaaatacatgaagaaagtcatgccatttgttgccatgattaaggaaaatctggagaagatggggcctcgtattctggatttgcaattagaatttgatgaaaaggctgtgcttatggagaatatagtctatctgactaattcgcttgagctagaacacatagaagtcaagtttgcctccgaagcagaagataaaatcagggaagactgctgtcctgggaaaccacttaatgtttttagaatagaacctggtgtgtccgtttctctggtgaatccccagccatccaatggccacttctcaaccaaaattgaaatcaggcaaggagataactgtgattccataatcaggcgtttaatgaaaatgaatcgaggaattaaagacctttccaaagtgaaactgatgagatttgatgatccactgttggggcctcgacgagttcctgtcctgggaaaggagtacaccgagaagacccccatttctgagcatgctgttttcaatgtggacctcatgagcaagaaaattcatctgactgagaatgggataagggtggatattggcgatacaataatctatctggttcattaaactcatgcacattggagatttatcctggtttcttaggaatactactactctgattgtgtctactgattggctatcagaaccttaggctggacctaaatagattgatttcatttctaaccatccaattctgcatgtattcataattctatcaagtcatctttgattcctggacctaataaattttttttccctttctttgggtgtccaagagaaatggtttttgccaaactctttttaaaaaacaaattgttgctatttcctagaagtttctggtttttaagatgaacataaaagtgtcagtatgcttcttttatgaggtgtactttatactttgatgaaggctaaggtgtacctaacagctttttatagtatattcatttatggagttagctgtatttttttttaaaaaagaaaagtagtaaattagcagcttttttttttaaatgaagagaacttcatgatgatttaaaagaactaatgagaatattttgacttgacttcaattactaagtattttgtataaagaacaaataggtcctgcattttataagactttttaaagctttaattattcaactaagaaccaataatggcttcttcaaggctaatatcaatagtttataagcagtatatttcacctacactaaatatgggcattttaaaagaagattccccccttcccccccagaaatctgcatttactaaatttgtcttaagtccaattgtgtttaaaggtcatgctggtcgggtgtggtggctcacacctataatcccagcactttgggaggccaaggtgggcagtcacctgaggtcaggagtttgagaccagcctgaccaacatggtgaaaccccgtctctactaaaaatacaaaaattagcttggcatggtggcgggtacctgtaatcccagctgcttgggagtgtgaggcaggagaatcgcttgaacctgggagaccgaggttgcagtgagctgaaaccgtgccattgcactccagcttaggcaacaagagtgaaactctgtctcaatcaatccatcaatcaatcaataaaatagaggtcatgctgactattacagatttaaaaaaaaaaaaaaaaaaaa

SEQ ID NO: 394 - DNA, 2537 bp, Human
gtccaggattctggctcagagttgcaccactgggttttatattcacttggatctttagttgttttggcgcctactgaggtctgaagtttgaatcctgcagtcaattgggatggtggcttgtaccccaaagtgccattgcaacccttgtccttcctgaggaaagggtggcagttgccctgtggaattcctgccctgctccccgtgggtgtccaggctgacagaagttgggactgtgtctggctggccgtaggaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccaggtgtgttggggccttggcctcccctgctgaaggtggggattgcccatccatctgcttacaattccctgctgtcgtcttagcaagaagtaaaatgagaaattttgttgatattctctccttaaaaaaaaaaaaaaaaaaaaaaaaaaaaaa

SEQ ID NO: 395 - DNA, 5061 bp, Human
ggtctgcagcgcaagcgcagtgcggataaacaggaagcgggcggtggaggcagcagcagagggagagctcggggcttggaggggaaacagcggaagacctaagattatcgggagggcagcagaggcagagaacgaggacaggacccttggccgtcttcttccagggaacgagaggtcacagcctcgctctccgcttaggcttctggcgccccagcttaaagccgaggctgcggctgacaaagggctcgcgccggtgccgccgcccttctcatccgggcattcgggtccctgcggagagggagggggaagggcagagggggaggggaaggagccggaggggcgcacacttggagctgaagccctctccagggctccgggccggtgccccaacggacagaggtcgaggaggacccgcagaggtggcagcggccgggggcaggaggatggtgcagaaggagagtcaagcgacgttggaggagcgggagagcgagctcagctccaaccctgccgcctctgcgggggcatcgctggagccgccggcagctccggcacccggagaagacaaccccgccggggctgggggagcggcggtggccggggctgcaggaggggctcggcggttcctctgcggtgtggtggaaggattttatggaagaccttgggttatggaacagagaaaagaactctttagaaggctccagaaatgggaattaaatacatacttgtatgccccaaaagatgactacaaacataggatgttttggcgagagatgtattcagtggaggaagctgagcaacttatgactctcatctctgctgcacgagaatatgagatagagttcatctatgcgatctcacctggattggatatcactttttctaaccccaaggaagtatccacattgaaacgtaaattggaccaggtttctcagtttgggtgcagatcatttgctttgctttttgatgatatagaccataatatgtgtgcagcagacaaagaggtattcagttcttttgctcatgcccaagtctccatcacaaatgaaatctatcagtacctaggagagccagaaactttcctcttctgtcccacagaatactgtggcactttctgttatccaaatgtgtctcagtctccatatttaaggactgtgggtgaaaagcttctacctggaattgaagtgctttggacaggtcccaaagttgtttctaaagaaattccagtagagtccatcgaagaggtttctaagattattaagagagctccagtaatctgggataacattcatgctaatgattatgatcagaagagactgtttctgggcccgtacaaaggaagatccacagaactcatcccacggttaaaaggagtcctcactaatccaaattgtgaatttgaagccaactacgttgctatccacacccttgccacctggtacaaatcaaacatgaatggagtgagaaaagatgtagtgatgagtaggcaagttgcacacagtggagctaaagcaagtgtagttgatgggactcctttagttgcagcaccctctttaaatgccacaaccgtagtaacaacagtttatcaggagcccattatgagccagggagcagccttgagtggtgagcctactactctgaccaaggaagaagaaaagaaacagcctgatgaagaacccatggacatggtggtggaaaaacaagaagaaacggaccacaagaatgacaatcaaatactgagtgaaattgttgaagcgaaaatggcagaggaattgaaaccaatggacactgataaagagagcatagctgaatcaaaatccccagagatgtccatgcaagaagattgtattagtgacattgcccccatgcaaactgatgaacagacaaacaaggagcagtttgtgccaggtccaaatgaaaagcctttgtacactgcggaaccagtgaccctggaggatttgcagttacttgctgatctattctaccttccttacgagcatggacccaaaggagcacagatgttacgggaatttcaatggcttcgagcaaatagtagtgttgtcagtgtcaattgcaaaggaaaagactctgaaaaaattgaagaatggcggtcacgagcagccaagtttgaagagatgtgtggactagtgatgggaatgttcactcggctctccaattgtgccaacaggacaattctttatgacatgtactcctatgtttgggatatcaagagtataatgtctatggtgaagtcttttgtacagtggttagggtgtcgtagtcattcttcagcacaattcttaattggagaccaagaaccctgggcctttagaggtggtctagcaggagagttccagcgtttgctgccaattgatggggcaaatgatctcttttttcagccacctccactgactcctacctccaaagtttatactatcagaccttattttcctaaggatgaggcatccgtgtacaagatttgcagagaaatgtatgacgatggagtgggtttaccctttcaaagtcagcctgatcttattggagacaagttagtaggagggctgctttccctcagcctggattactgctttgtcctagaagatgaagatggcatatgtggttatgccttgggcactgtagatgtgaccccctttattaaaaaatgtaaaatttcctggatccccttcatgcaggagaagtataccaagccaaatggtgacaaggaactctctgaggctgagaaaataatgttgagtttccatgaagaacaggaagtactgccagaaactttccttgctaatttcccttctctgataaagatggacattcacaaaaaagtaactgacccaagtgtggccaaaagcatgatggcttgcctcctgtcttcactgaaggctaatggctcccggggagctttctgtgaagtgagaccagatgataaaagaattctggaattttacagcaagttaggatgttttgaaattgcaaaaatggaaggatttccaaaggatgtggttatacttggtcggagcctgtgacatttgttgacactgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaagaatatagtattgcagcaaatcctgtatgaaagagagatgtgggcttcctttttgagtcttgtgttaggtgctgagaccttttacatgggcttatacagggagagagtcttcaataaatgtagtcagcactattttctgcatccagtgtggttgcgtttctcacctgagagtaatcaagataacatctgtcatcttccttggtttattgagtgaaatgcctctcagtcttaggggacatggcagagatgaaagaaagaaagagtgggtttcagaagtgtcagggtggagtgattccaagtgggatggttgtggcattagtttaagctgaataaataatttcaatttggggcagttattctgctttttgtaaagccgtggccaattgtctcctgtaatgactgttggttcaggcatgttgtactttgtagggacaaatgtgcatttgtttgtggcaaaagcctacaattgacaaacttgtaaatttctttgtatataaactagctgtaacctgactatcctttgtgtttactgtttttgtaaatttttttcctctataaatgaaagggtgttggttcagaatggcactttgaataatgtaaaccagtgaaaagtggattttctttacttttgtctttgggtttggggttgtttttgttctttttgaagttttattatttttaaagtgcctcccacctaggcgtaggccatgaccatttggggtacgagagcctaattttgtaggacttaatctgttgaaaagtgcagttacttctggaaattaacctcaatattaggtcagcatgtgaaatgttggatttgacatgtcaggtagggttcagggactgattggtcccatttgccctcaggtcagttgtttaatctcaagacctgttactactgattttattaaatcagagtctttaattcttgcatgtttgtatctaatttctgaacgaatgagcacactttaaccagttatttacagttacctttttcctttaaccggattgtgaaagcttcatgtattttaatttagattctgtgtttttaagggttctgagcatgaagctggcagatagtcggcaggactcattttttcatcatggctggctgatttctccatagattgataacagtattttgttatcttgcttctctgtagttttgcatcagctgtttaactttgagctgagtgaggggagaggggtaaagagaaagaaacttaagttttctttcacagaactccaccattgtgggctttgagagagccctaaagcattgtacctagtggtacctagtgacttccaaccaaagcctttgagtatgcactaaataggtgagaagaaaggagagaaggtttttaggttagaaacctttaaccgatagaaggatatggtatgttgtaaagctggaaccaagtttgcatttttgagggcttgagatgaagggaagactcttaccagatagtaagacagctgagttttcctcagttttctcgtcttaacactagtggacaattctagcattttgtttggaggatttcagagttaacctcatggaattcaggattttttagcaagtttgcttttggttttatcttggcttttagtaatcatgttggctggtctggtcacaggtgactgtgaaacagatgccctggtcttgctttcatcactctaggatcatgaagtgctatgctatttcctggttatgaatattaaggttggaattacatttttattgattgtttggatcagagctcagttcctgtagaaaacgaactgtaaaagaccatgcaagaggcaaaataaaacttgaagtgaatgcttgtaaaaaaaaaaaaaaaaaa

SEQ ID NO: 396 - DNA, 1523 bp, Human
cggggcggggccgcgtgacgtgccgggaagccggagtctagagctccgggcgcggggaggcgcggccatggcagctccggagccgctgtccccggcgggcggtgcgggcgaggaggcgccggaggaggacgaggacgaagcggaggccgaggaccctgagcggccgaatgcgggagcgggcggtggacgcagtggcggcggcggcagtagcgtcagcggaggaggcggcggcggcggggccggggcggggggctgcggcgggcccgggggcgcgctcaccaggcgcgcggtcacactgcgggtgctcctcaaagacgcgctgctggagcctggcgccggggtgctgtccatctactacctggggaagaagttcctgggcgacctgcagccagacggaaggatcatgtggcaggagaccgggcagaccttcaactcacccagcgcctgggccacccactgcaagaagctggtgaaccctgccaagaagtcgggctgtggctgggcctctgtcaagtacaaaggccagaaactggacaagtacaaggccacctggctccggctgcaccagctgcacacgcctgccacggctgctgatgagagcccagccagtgaaggggaggaggaggagttgctgatggaagaggaggaggaggacgttctggcaggggtctcagcagaggacaagagtcggagaccactggggaagagcccttcagagcctgcccacccggaggccacaaccccagggaagcgggtggacagcaagatccgggttccggtccgctactgcatgctgggcagccgcgacttggccaggaacccccacaccctggtggaagtaacatcctttgcagccatcaacaagttccagccgttcaacgtggctgtttctagcaacgtgctgttcctgctgatctaccagagcctgttcctgcggggcctgtccctggtgggctggtaccacagccacccacacagcccggcgctgccatctctgcaggacatcgacgcacagatggactaccagctgcggctgcagggctccagcaatggcttccagccctgcctcgccctgctctgctccccttactattctggcaacccaggccccgagtccaagatctcacctttctgggtgatgcctcctcccgagcaaaggcccagtgactatggcatccccatggatgtggagatggcctacgtccaggacagcttcctgaccaatgacatccttcacgagatgatgctgctggtggagttctacaagggttcccctgacctcgtgaggctccaggaaccctggagccaggagcacacctacctcgacaagcttaagatctccttggccagcaggacgcccaaggaccagagcctgtgtcacgtcctggaacaggtgtgcggcgtcctcaagcaggggagctgagccttccagggcagggtgggctccagttgtcttgagggtccggatgggctcaggtaataaagaaacggaagcagcagccagccaaaaaaaaaaaaaaaaa

SEQ ID NO: 397 - DNA, 4472 bp, Human
ccgcagacgcctgggaactgcggccgcgggctcgcgctcctcgccaggccctgccgccgggctgccatccttgccctgccatgtctcgccggaagcctgcgtcgggcggcctcgctgcctccagctcagcccctgcgaggcaagcggttttgagccgattcttccagtctacgggaagcctgaaatccacctcctcctccacaggtgcagccgaccaggtggaccctggcgctgcagcggctgcagcggccgcagcggccgcagcgcccccagcgcccccagctcccgccttcccgccccagctgccgccgcacatagctacagaaattgacagaagaaagaagagaccattggaaaatgatgggcctgttaaaaagaaagtaaagaaagtccaacaaaaggaaggaggaagtgatctgggaatgtctggcaactctgagccaaagaaatgtctgaggaccaggaatgtttcaaagtctctggaaaaattgaaagaattctgctgcgattctgcccttcctcaaagtagagtccagacagaatctctgcaggagagatttgcagttctgccaaaatgtactgattttgatgatatcagtcttctacacgcaaagaatgcagtttcttctgaagattcgaaacgtcaaattaatcaaaaggacacaacactttttgatctcagtcagtttggatcatcaaatacaagtcatgaaaatttacagaaaactgcttccaaatcagctaacaaacggtccaaaagcatctatacgccgctagaattacaatacatagaaatgaagcagcagcacaaagatgcagttttgtgtgtggaatgtggatataagtatagattctttggggaagatgcagagattgcagcccgagagctcaatatttattgccatttagatcacaactttatgacagcaagtatacctactcacagactgtttgttcatgtacgccgcctggtggcaaaaggatataaggtgggagttgtgaagcaaactgaaactgcagcattaaaggccattggagacaacagaagttcactcttttcccggaaattgactgccctttatacaaaatctacacttattggagaagatgtgaatcccctaatcaagctggatgatgctgtaaatgttgatgagataatgactgatacttctaccagctatcttctgtgcatctctgaaaataaggaaaatgttagggacaaaaaaaagggcaacatttttattggcattgtgggagtgcagcctgccacaggcgaggttgtgtttgatagtttccaggactctgcttctcgttcagagctagaaacccggatgtcaagcctgcagccagtagagctgctgcttccttcggccttgtccgagcaaacagaggcgctcatccacagagccacatctgttagtgtgcaggatgacagaattcgagtcgaaaggatggataacatttattttgaatacagccatgctttccaggcagttacagagttttatgcaaaagatacagttgacatcaaaggttctcaaattatttctggcattgttaacttagagaagcctgtgatttgctctttggctgccatcataaaatacctcaaagaattcaacttggaaaagatgctctccaaacctgagaattttaaacagctatcaagtaaaatggaatttatgacaattaatggaacaacattaaggaatctggaaatcctacagaatcagactgatatgaaaaccaaaggaagtttgctgtgggttttagaccacactaaaacttcatttgggagacggaagttaaagaagtgggtgacccagccactccttaaattaagggaaataaatgcccggcttgatgctgtatcggaagttctccattcagaatctagtgtgtttggtcagatagaaaatcatctacgtaaattgcccgacatagagaggggactctgtagcatttatcacaaaaaatgttctacccaagagttcttcttgattgtcaaaactttatatcacctaaagtcagaatttcaagcaataatacctgctgttaattcccacattcagtcagacttgctccggaccgttattttagaaattcctgaactcctcagtccagtggagcattacttaaagatactcaatgaacaagctgccaaagttggggataaaactgaattatttaaagacctttctgacttccctttaataaaaaagaggaaggatgaaattcaaggtgttattgacgagatccgaatgcatttgcaagaaatacgaaaaatactaaaaaatccttctgcacaatatgtgacagtatcaggacaggagtttatgatagaaataaagaactctgctgtatcttgtataccaactgattgggtaaaggttggaagcacaaaagctgtgagccgctttcactctccttttattgtagaaaattacagacatctgaatcagctccgggagcagctagtccttgactgcagtgctgaatggcttgattttctagagaaattcagtgaacattatcactccttgtgtaaagcagtgcatcacctagcaactgttgactgcattttctccctggccaaggtcgctaagcaaggagattactgcagaccaactgtacaagaagaaagaaaaattgtaataaaaaatggaaggcaccctgtgattgatgtgttgctgggagaacaggatcaatatgtcccaaataatacagatttatcagaggactcagagagagtaatgataattaccggaccaaacatgggtggaaagagctcctacataaaacaagttgcattgattaccatcatggctcagattggctcctatgttcctgcagaagaagcgacaattgggattgtggatggcattttcacaaggatgggtgctgcagacaatatatataaaggacagagtacatttatggaagaactgactgacacagcagaaataatcagaaaagcaacatcacagtccttggttatcttggatgaactaggaagagggacgagcactcatgatggaattgccattgcctatgctacacttgagtatttcatcagagatgtgaaatccttaaccctgtttgtcacccattatccgccagtttgtgaactagaaaaaaattactcacaccaggtggggaattaccacatgggattcttggtcagtgaggatgaaagcaaactggatccaggcgcagcagaacaagtccctgattttgtcaccttcctttaccaaataactagaggaattgcagcaaggagttatggattaaatgtggctaaactagcagatgttcctggagaaattttgaagaaagcagctcacaagtcaaaagagctggaaggattaataaatacgaaaagaaagagactcaagtattttgcaaagttatggacgatgcataatgcacaagacctgcagaagtggacagaggagttcaacatggaagaaacacagacttctcttcttcattaaaatgaagactacatttgtgaacaaaaaatggagaattaaaaataccaactgtacaaaataactctccagtaacagcctatctttgtgtgacatgtgagcataaaattatgaccatggtatattcctattggaaacagagaggtttttctgaagacagtctttttcaagtttctgtcttcctaacttttctacgtataaacactcttgaatagacttccactttgtaattagaaaattttatggacagtaagtccagtaaagccttaagtggcagaatataattcccaagcttttggagggtgatataaaaatttacttgatatttttatttgtttcagttcagataattggcaactgggtgaatctggcaggaatctatccattgaactaaaataattttattatgcaaccagtttatccaccaagaacataagaattttttataagtagaaagaattggccaggcatggtggctcatgcctgtaatcccagcactttgggaggccaaggtaggcagatcacctgaggtcaggagttcaagaccagcctggccaacatggcaaaaccccatctttactaaaaatataaagtacatctctactaaaaatacgaaaaaattagctgggcatggtggcgcacacctgtagtcccagctactccggaggctgaggcaggagaatctcttgaacctgggaggcggaggttgcaatgagccgagatcacgtcactgcactccagcttgggcaacagagcaagactccatctcaaaaaaaaaaaaagaaaaaagaaaagaaatagaattatcaagcttttaaaaactagagcacagaaggaataaggtcatgaaatttaaaaggttaaatattgtcataggattaagcagtttaaagattgttggatgaaattatttgtcattcattcaagtaataaatatttaatgaatacttgctataaaaaaaaaaaaaaaaaaaaaaaaaa

SEQ ID NO: 398 - DNA, 2944 bp, Human
cgcctggaaacacgaacttccggtctcttaggctccgggccacagagacggtgtcagtggtagcctagagaggccgctaacagacaggagccgaacgggggcttccgctcagcagagaggcaagatggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatcccacacgaaaaaaaaaa

SEQ ID NO: 399 - DNA, 2088 bp, Human
gagctacttgaagaccaattagagtccgggaagcgcggcggggcctccagaccggggcgggcttaagggtgacatctgcgctttaaagggtccgggtcagctgactcccgactctgtggagtctagctgccagggtcgcggcagctgcggggagagatgactggggagcgacccagcacggcgctcccggacagacgctgggggccgcggattctgggcttctggggaggctgtagggtttgggtgtttgccgcgatcttcctgctgctgtctctggcagcctcctggtccaaggctgagaacgacttcggtctggtgcagccgctggtgaccatggagcaactgctgtgggtgagcgggagacagatcggctcagtggacaccttccgcatcccgctcatcacagccactccgcggggcactcttctcgcctttgctgaggcgaggaaaatgtcctcatccgatgagggggccaagttcatcgccctgcggaggtccatggaccagggcagcacatggtctcctacagcgttcattgtcaatgatggggatgtccccgatgggctgaaccttggggcagtagtgagcgatgttgagacaggagtagtatttcttttctactccctttgtgctcacaaggccggctgccaggtggcctctaccatgttggtatggagcaaggatgatggtgtttcctggagcacaccccggaatctctccctggatattggcactgaagtgtttgcccctggaccgggctctggtattcagaaacagcgggagccacggaagggccgcctcatcgtgtgtggccatgggacgctggagcgggacggagtcttctgtctcctcagcgatgatcatggtgcctcctggcgctacggaagtggggtcagcggcatcccctacggtcagcccaagcaggaaaatgatttcaatcctgatgaatgccagccctatgagctcccagatggctcagtcgtcatcaatgcccgaaaccagaacaactaccactgccactgccgaattgtcctccgcagctatgatgcctgtgatacactaaggccccgtgatgtgaccttcgaccctgagctcgtggaccctgtggtagctgcaggagctgtagtcaccagctccggcattgtcttcttctccaacccagcacatccagagttccgagtgaacctgaccctgcgatggagcttcagcaatggtacctcatggcggaaagagacagtccagctatggccaggccccagtggctattcatccctggcaaccctggagggcagcatggatggagaggagcaggccccccagctctacgtcctgtatgagaaaggccggaaccactacacagagagcatctccgtggccaaaatcagtgtctatgggacactctgagctgtgccactgccacaggggtattctgccttcaggactctgccttcaggaacacgggtctgtagagggtctgctggagacgcctgaaagacagttccatcttcctttagactccagccttggcaaaatcaccttccctttaccagggaaatcacttcctttaggactgaaagctaggcgtcctctcccacaaaaaagtcctgccctcatctgagaatactgtctttccatatggctaagtgtggccccaccaccctctctgccctcccgggacattgattggtcctgtcttgggcaggtctagtgagctgtagaattgaatcaatgtgaactcagggaactggggaaggctgagcctcctctttggtgttgcggtaagataaccgacagggctggtgaaagtccccagatggcaggatatttggtttcagagtaaggactaggtgcaccaccatgactgactatcaatcaaaatgtttgtaacttaaaatttttaatgaaggataatgaatatttgtagagtctctatggttctgtcaatgcacatcttcgtgtctgttttcctcatgtatccttgtgagcctgggtgagttctggggagagacctgatgtgcgtactgcctgtgaaaatctgactttggcaaatcaaatcctcttttccttttgaaaaaaaaaaaaaaaaaa

SEQ ID NO: 400 - DNA, 2596 bp, Human
gagcctcgaagtccgccggccaatcgaaggcgggccccagcggcgcgtgcgcgccgcggccagcgcgcgcgggcgggggggcaggcgcgccccggacccaggatttataaaggcgaggccgggaccggcgcgcgctctcgtcgcccccgctgtcccggcggcgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacctgtaaaaaaaaaaaaaaaaaa

SEQ ID NO: 401 - DNA, 4717 bp, Human
attatgcaacccgcctccccgcccgcccggtggagcttccactcggctgcgggctggagcggcggcgggcaggcgtgcggaggacactcctgcgaccaggtactggctgtgatcgaacttctcaaccctcagagacttagatcttccacctcactccctcagccaagcctccaggccccctcgtgcatccgtggtggcctctctgccttctctgttctgttctccccatggcccagacatgagtggccccctagaaggggctgatgggggaggggaccccaggcctggggaatcattttgtcctgggggcgtcccatcccctgggcccccacagcaccggccttgcccaggccccagcctggccgatgacaccgatgccaacagcaatggttcaagtggcaatgagtccaacgggcatgagtctagaggcgcatctcagcggagctcacacagctcctcctcaggcaacggcaaggactcagccctgctggagaccactgagagcagcaagagcacaaactctcagagcccatccccacccagcagttccattgcctacagcctcctgagtgccagctcagagcaggacaacccgtccaccagtggctgcagcagtgaacagtcagcccgggcaaggactcagaaggaactcatgacagcacttcgagagctcaagcttcgactgccgccagagcgccggggcaagggccgctctgggaccctggccacgctgcagtacgcactggcctgtgtcaagcaggtgcaggccaaccaggaatactaccagcagtggagcctggaggagggcgagccttgctccatggacatgtccacctataccctggaggagctggagcacatcacgtctgagtacacacttcagaaccaggataccttctcagtggctgtctccttcctgacgggccgaatcgtctacatttcggagcaggcagccgtcctgctgcgttgcaagcgggacgtgttccggggtacccgcttctctgagctcctggctccccaggatgtgggagtcttctatggttccactgctccatctcgcctgcccacctggggcacaggggcctcagcaggttcaggcctcagggactttacccaggagaagtccgtcttctgccgtatcagaggaggtcctgaccgggatccagggcctcggtaccagccattccgcctaaccccgtatgtgaccaagatccgggtctcagatggggcccctgcacagccgtgctgcctgctgattgcagagcgcatccattcgggttacgaagctccccggataccccctgacaagaggattttcactacgcggcacacacccagctgcctcttccaggatgtggatgaaagggctgcccccctgctgggctacctgccccaggacctcctgggggccccagtgctcctgttcctgcatcctgaggaccgacccctcatgctggctatccacaagaagattctgcagttggcgggccagccctttgaccactcccctatccgcttctgtgcccgcaacggggagtatgtcaccatggacaccagctgggctggctttgtgcacccctggagccgcaaggtagccttcgtgttgggccgccacaaagtacgcacggcccccctgaatgaggacgtgttcactcccccggcccccagcccagctccctccctggacactgatatccaggagctgtcagagcagatccaccggctgctgctgcagcccgtccacagccccagccccacgggactctgtggagtcggcgccgtgacatccccaggccctctccacagccctgggtcctccagtgatagcaacgggggtgatgcagaggggcctgggcctcctgcgccagtgactttccagcagatctgtaaggatgtgcatctggtgaagcaccagggccagcagctttttattgagtctcgggcccggcctcagtcccggccccgcctccctgctacaggcacgttcaaggccaaggcccttccctgccaatccccagacccagagctggaggcgggttctgctcccgtccaggccccactagccttggtccctgaggaggccgagaggaaagaagcctccagctgctcctaccagcagatcaactgcctggacagcatcctcaggtacctggagagctgcaacctccccagcaccactaagcgtaaatgtgcctcctcctcctcctataccacctcctcagcctctgacgacgacaggcagaggacaggtccagtctctgtggggaccaagaaagatccgccgtcagcagcgctgtctggggagggggccaccccacggaaggagccagtggtgggaggcaccctgagcccgctcgccctggccaataaggcggagagtgtggtgtccgtcaccagtcagtgtagcttcagctccaccatcgtccatgtgggagacaagaagcccccggagtcggacatcatcatgatggaggacctgcctggcctagccccaggcccagcccccagcccagcccccagccccacagtagcccctgacccagccccagacgcctaccgtccagtggggctgaccaaggccgtgctgtccctgcacacacagaaggaagagcaagccttcctcagccgcttccgagacctgggcaggctgcgtggactcgacagctcttccacagctccctcagcccttggcgagcgaggctgccaccacggccccgcacccccaagccgccgacaccactgccgatccaaagccaagcgctcacgccaccaccagaaccctcgggctgaagcgccctgctatgtctcacacccctcacccgtgccaccctccaccccctggcccaccccaccagccactacccccttcccagcggttgtccagccctaccctctcccagtgttctctcctcgaggaggcccccagcctcttccccctgctcccacatctgtgcccccagctgctttccccgcccctttggtgaccccaatggtggccttggtgctccctaactatctgttcccaaccccatccagctatccttatggggcactccagacccctgctgaagggcctcccactcctgcctcgcactccccttctccatccttgcccgccctcgccccgagtcctcctcaccgcccggactctccactgttcaactcgagatgcagctctccactccagctcaatctgctgcagctggaggagctcccccgtgctgagggggctgctgttgcaggaggccctgggagcagtgccgggcccccacctcccagtgcggaggctgctgagccagaggccagactggcggaggtcactgagtcctccaatcaggacgcactttccggctccagtgacctgctcgaacttctgctgcaagaggactcgcgctccggcacaggctccgcagcctcgggctccttgggctctggcttgggctctgggtctggttcaggctcccatgaagggggcagcacctcagccagcatcactcgcagcagccagagcagccacacaagcaaatactttggcagcatcgactcttccgaggctgaggctggggctgctcggggcggggctgagcctggggaccaggtgattaagtacgtgctccaggatcccatttggctgctcatggccaatgctgaccagcgcgtcatgatgacctaccaggtgccctccagggacatgacctctgtgctgaagcaggatcgggagcggctccgagccatgcagaagcagcagcctcggttttctgaggaccagcggcgggaactgggtgctgtgcactcctgggtccggaagggccaactgcctcgggctcttgatgtgatggcctgtgtggactgtgggagcagcacccaagatcctggtcaccctgatgacccactcttctcagagctggatggactggggctggagcccatggaagagggtggaggcgagcagggcagcagcggtggcggcagtggtgagggagagggctgcgaggaggcccaaggcggggccaaggcttcaagctctcaggacttggctatggaggaggaggaagaaggcaggagctcatccagtccagccttacctacagcaggaaactgcaccagctagactccattctgggaccatctccaggagtccatgagaggctttcttctcctatgtcccaattctcagaactcagatgtggctagaccaaccagtgggaaactgccccagcttctcccaccatagggggccggacccccatcaccagcctaggatccaggggctgcctctggcctcttagggagcagagagcagaactccgcagcccagcccagaggagtgtcacctcccacctttggagaggaatccttccctcccctggacaaagttgctgacaagctgctgaagtggcctctccatattccagctgagcctgaatctgactcttgagggttggggctgcacttatttattgcggggagacagctctctctcccacctcctccccagatgggaggagagcctgaggcccaagcaggacccgggggttccagcccctagctgctctggagtgggggaggttggtggaccatggagtccctggtgctgcccctcaggtgggacccaggcgttctcagctgtaccctctgccgatggcatttgtgtttttgatatttgtgtctgttactacttttttaatacaaaaagataaaaacgcccaaaaaaaaa

SEQ ID NO: 402 - DNA, 1945 bp, Human
gattagtcaggcctcagaaagatggcgtcctcggagcaggcagagcagccgagccagccaagctctactccaggaagtgaaaatgtgctgcctcgagagccgctgattgccacggcagtgaagtttctacagaattcccgggtccgccagagcccacttgcaaccaggagagcattcctaaagaagaaagggctgacagatgaagagattgatatggccttccagcagtcgggcactgctgccgatgagccttcgtccttgggcccagccacacaggtggttcctgtccagccccctcacctcatatctcagccatacagtcccgcaggctcccgatggcgagattacggcgccctggccatcatcatggcaggcattgcatttggctttcaccagctctacaagaaatacctgctccccctcatcctgggcggccgagaggacagaaagcagctggagaggatggaggccggtctctctgagctgagtggcagcgtggcccagacagtgactcagttacagacgaccctcgcctccgtccaggagctgctgattcagcagcagcagaagatccaggagcttgcccacgagctggccgctgccaaggccaccacatccaccaactggatcctggagtcccagaatatcaacgaactcaagtccgaaattaactccttgaaagggcttcttttaaatcggaggcagttccctccatccccatcagccccgaagatcccctcctggcagatcccagtcaagtcaccgtcaccctccagccctgcggccgtgaaccaccacagcagcagcgacatctcacctgtcagcaacgagtccacgtcgtcctcgcctgggaaggagggccacagccccgagggctccacggtcacctaccacttgctgggcccccaggaggaaggcgagggggtggtggacgtcaagggccaggtgcggatggaggtgcaaggcgaggaggagaagagggaggacaaggaggacgaggaggatgaggaggatgatgatgtgagccatgtggacgaggaggactgcctgggggtgcagagggaggaccgccggggcggggatgggcagatcaacgagcaggtggagaagctgcggcggcccgagggcgccagcaacgagagtgagcgggactagggctgcgcctgctgcctccagccctgaggatggcatctagtgtgcccgtgcgtggccataccctgcctccctctctggccctgggagggcagcttggagcccaggtagggggcagagctgtcctcagctgcactgcggcctggtggcagtgtggggagtcacacttctgtccacctggcctcctctcgcctggccgccagccccagccccagccccagccccaggcccagctgcctttggctttgatctcaagtcaggctgaaggcagcgaagcctcggggcccaagcccctccccagccccctctcccggacagacgccttgcccagggtgtgtttgctgagtgtcttgactaccgtgacaccacgcatggccagagctagcgtccctactgcctcccgactcctcagtggaggaggagctgcggtccctctggtgtctgccatccccctccctccctgggcccggccctggacccgtcaggtgcctgtccccagccccaaccccactcatgccccgtcgtcctcccagacaaatgaaaccacgctgcgcttccgatgcccccgcttgccgtgtaatggttcagctaatcccatggcgagatgggggctcactccggaggaggagccaggcagcagggccttcctgaccaacagccagctctgtccttccccccaggaaacacatgttcatttgtgtgatcatgtatagacctcagaacggaagataggactgtatataattgtaataaataccagttgccactatttaaaaaaaaaaaaaaaaaaaaa

SEQ ID NO: 403 - DNA, 1132 bp, Human
aggtctttgccccgcctctcggccccgcggcctggccggcaagcagggctgcagtcacggggcggcgcggagggccccagcccagtcaggggtgtggccgccgccaccgtaaggctaggccgcgagcttagtcctgggagccgcctccgtcgccgccgtcagagccgccctatcagattatcttaacaagaaaaccaactggaaaaaaaaatgaaattccttatcttcgcatttttcggtggtgttcaccttttatccctgtgctctgggaaagctatatgcaagaatggcatctctaagaggacttttgaagaaataaaagaagaaatagccagctgtggagatgttgctaaagcaatcatcaacctagctgtttatggtaaagcccagaacagatcctatgagcgattggcacttctggttgatactgttggacccagactgagtggctccaagaacctagaaaaagccatccaaattatgtaccaaaacctgcagcaagatgggctggagaaagttcacctggagccagtgagaataccccactgggagaggggagaagaatcagctgtgatgctggagccaagaattcataagatagccatcctgggtcttggcagcagcattgggactcctccagaaggcattacagcagaagttctggtggtgacctctttcgatgaactgcagagaagggcctcagaagcaagagggaagattgttgtttataaccaaccttacatcaactactcaaggacggtgcaataccgaacgcagggggcggtggaagctgccaaggtgggggctttggcatctctcattcgatccgtggcctccttctccatctacagggcttttagcagagtgaactgtttcgtggacactgtcacaggaagtggaaactcaccttgtgaaaagtacattctgaccctgaagacgtttaagtacatgacgaggatgtcactggagtgtgacaaattcttcacattctcacttccctttgctaattctggcgtcagaagttattgcagagaacatagtcaaccgtctgtggagatacatctaaaacagatgtgcctattgttaaacaaacatggtatgtttaaatccatatttatttattaaacaaaaa

SEQ ID NO: 404 - DNA, 6256 bp, Human
cgcgccgccgctcgctcacctgcgctcccgcccgcccctcggtgcgcgcccggcccgccagccgccgccgcccgcaccccgagcgccaccatgaactcgctcttcaggaagagaaacaaaggcaaatacagccccactgtgcagacccggagcatctctaacaaggagctctcggagctgatcgagcagctgcagaagaatgccgaccaggtggagaagaacatcgtggacacagaggccaagatgcagagtgacctggctcggctgcaggagggtcggcagcctgagcaccgggacgtgaccctgcagaaggtgttggactctgagaagctgctctatgtgctagaggcggatgcggccattgccaagcacatgaagcacccacagggggacatgatcgccgaggatatccgccagctgaaggagcgtgtgaccaacctgcgcgggaaacacaagcagatctacaggctggcggtgaaggaagtggatccacaggtcaactgggcggcactggtggaggagaagctggacaagctgaacaaccagagctttgggactgacctgccgctggtggaccaccaagtggaggagcataacatcttccacaatgaggtcaaggccatcgggccccacctggccaaggacggggacaaggagcagaacagcgaactccgggccaagtaccagaaactgctggcagcatcacaggcccggcagcagcacctgagttcgctgcaggactacatgcagcgctgcaccaatgagctgtactggctggaccagcaggccaagggccgcatgcagtacgactggagtgaccgcaacctcgactaccccagccgccggcgccagtatgagaatttcatcaaccggaacctggaggccaaagaggagagaatcaacaaactgcacagcgagggcgaccagctgctggcggccgagcaccccgggaggaactccattgaggcgcacatggaggctgtgcacgcagactggaaggagtacctgaacctgctcatctgcgaggagagccacctcaagtacatggaggactaccaccagtttcacgaagacgtgaaggacgctcaggagctgctgcgcaaggtggactcggacctgaaccagaagtatggccctgacttcaaggaccggtaccagattgagctgctgctgcgggagctggatgaccaggagaaggtgctggacaagtatgaggacgtggtgcaggggctgcagaagcgaggccagcaggtggtgcccctcaagtaccgccgggagactccgctcaagcccatccccgtggaggcactctgtgactttgagggggagcagggcctgatctcgcggggctacagctacaccctgcagaagaacaacggggagagctgggagctcatggacagcgctgggaacaagctgattgctccggccgtgtgttttgtgatcccccccacagaccctgaggccctggctctggctgacagcctgggcagccagtaccggagcgtgcggcagaaggcagctgggagcaaacgcacgctgcagcagcggtatgaggtgctgaagaccgagaatcccggagatgcctctgacctacaggggcggcagctgctggctggcttggacaaggtggccagcgacctggaccggcaggagaaggccatcacagggatcctgcggccaccactggagcaaggccgggctgtgcaggacagtgccgagcgggccaaggacctcaagaacatcaccaacgagctactgcggattgaacctgagaagacgcggagcacggctgagggcgaagccttcatccaggccctcccaggcagtggcaccacacccctgctgaggacccgggtggaggacaccaaccggaaatacgagcacctcctgcagctgctggacttggcccaggagaaggttgatgtggccaaccgcctggagaagagcctgcagcagagctgggagttgctggccacacacgagaaccatctgaatcaggatgacacagtgcctgagagcagccgtgtcctggacagcaaggggcaggagctggcggccatggcctgtgagttacaggcccagaagtccctcctgggtgaggtggagcagaacttgcaggcggccaagcagtgctcgagcacactggccagccgcttccaggagcactgtccggacctggagcgccaggaggccgaggtgcacaagctgggccagcgtttcaacaacctgcgccagcaggtggaacgcagggcgcagagcctacagagcgccaaggcagcctacgagcacttccaccgcggccatgaccacgtgctgcagttcctagtcagcatccccagttacgagccccaggagacagacagcctcagccagatggagaccaagctgaagaaccagaagaacctgctagatgagatagcaagtagggagcaggaagtacagaagatctgtgccaattcccagcagtaccagcaagctgtaaaggactatgagttagaagcagaaaaactaaggtctcttctcgacttggagaatggaaggagcagccacgtgagcaagagagccaggctccaatctcctgccaccaaagtgaaggaagaggaagcagcacttgccgccaagttcactgaagtttatgccatcaacagacagaggctgcagaatctggagtttgctctgaatctcctcagacagcagccggaagtagaagtgacccatgagaccctgcaaaggaataggccggactctggagtggaggaggcgtggaagatcaggaaggaactggatgaggagactgagcggaggcggcagctggagaacgaggtcaagagcacccaggaagaaatctggaccttgaggaatcaggggcctcaggaatcggtggtgaggaaggaggtgctcaagaaggtgccggatcccgtgctggaggagagcttccagcagctgcagcggacgctggcagaggagcagcacaagaaccagctgctgcaggaggagctggaggcactgcagctgcagctgcgtgccctggagcaggagaccagagacggggggcaggagtacgtggtcaaggaggtcctgcgcatcgagcctgacagggcccaggcggatgaggtcttgcagctgcgggaggagctggaggcactgaggcggcagaagggcgcccgggaggcagaggtgctcctcctgcagcagcgtgtggccgccctggctgaagagaagagccgggcgcaggagaaggtcacagagaaagaggtggtgaaactgcagaatgacccccagctggaggcagagtaccagcagctgcaggaggaccaccagcgccaggaccagctcagggagaagcaggaggaggagctgagcttcctccaggacaagctcaagaggctagagaaggagcgggccatggccgagggcaagatcaccgtcaaggaggtgctcaaggtggagaaggacgcggccaccgagagggaggtcagcgatctcacccgccaatatgaggacgaggctgccaaggctcgcgctagccagagggagaagacggagctgctccgaaagatatgggccttggaggaggagaacgccaaagtggtggtgcaggagaaggtgcgggagatcgtgcggccagaccccaaggcggaaagtgaagtggcgaacctccgcctggagcttgtggagcaggagcgaaagtaccggggtgccgaggagcagctccggagctaccagagtgagctggaggccctcaggaggcgaggcccccaggtggaagtcaaagaggtgactaaggaagtcattaagtacaagactgaccctgagatggagaaggagcttcagcggctcagggaggagatcgtggacaagaccagactgatcgaaaggtgtgatttagagatctaccagctgaaaaaggaaatccaggccctgaaagacaccaaaccccaggtccagaccaaagaggtggtccaggagatcctccaattccaagaagaccctcaaaccaaggaggaggtggcgtctctgagggcaaagctctcagaggagcagaagaaacaagtggatctggagagggaaagagcttcccaggaagagcagatcgcccggaaagaggaggagctctcgcgggtgaaggaaagggtggtgcagcaggaggtggtcaggtatgaggaggagccaggcctgcgggccgaggcgagcgcctttgccgagagcatcgatgtggagctgcggcagattgacaagctgcgggcagagctgcggcggctgcagcgccggcgcaccgagcttgagcggcagctggaggagctagagcgcgagcggcaggcccgcagggaggccgagcgcgaggtacagcggttgcagcagcggctggcagcgctggagcaggaagaagctgaggcccgtgagaaggtaacccatacgcagaaggtggtgctgcagcaggacccgcagcaggcgcgagagcatgccctgctccgactccagctggaagaagagcagcaccggcggcagctcctggagggggagctcgagaccctccggaggaaactggctgcactggagaaggcggaggtcaaggagaaggtggtgctctccgagagtgtccaggtggagaagggcgacaccgagcaagagatccagaggctcaagagcagcctggaggaggagagccgcagcaagcgcgagctggacgtcgaggtgagccggctggaagccaggctttcggagctggaattccataactccaagtcatccaaggaactagactttctgagggaagagaaccacaaattacagctggagaggcaaaacctgcagctggagacccgaaggctccaatcggaaatcaacatggcagcgacggaaacacgagacctgcggaacatgaccgtggcggactctgggaccaaccatgactccagactgtggtccctggagagggaactggatgacctcaagaggctctccaaggacaaagacctcgagatcgacgagctgcagaagcgcctgggctccgtggccgtcaagcgggagcagcgggagaaccacctgcggcgctccatcgtagtcatccaccctgacacaggccgcgagctgtccccggaggaagcccaccgtgccgggctcattgactggaacatgttcgtgaaactcagaagccaggagtgcgactgggaggagatctcagtgaagggtcccaatggggagtcctcagtgatacacgacaggaagtctggcaagaagttctccatcgaagaggccctgcagagtggcaggctgacccctgctcagtatgaccgctatgtcaacaaggatatgtccatccaggagctggcggtcttggtatctgggcagaagtaggcacagctcttgcaactcttcgtaacggcagacgctggccctctcctacgacgcagtgacctccttggtgtcgtcctctccctagccctggtgcaggccaagcattttatacataccctcgctgccaggctgctcagagtcccgcccacatatgagacaggcactggctgaagacaggcaactctcgtcccaaccatcattcaccctgagtgacgtacttcatcctccaatgactggacaactgcgatgccttttcctcccttttcctgtacactcccagcaacaaactcctcatgataactgcacacaatctgaaaaccactgaaggacaagccaaccacagcagccaagcccactccttgcagcatgggtactggtggcacaccagacagtgacactgccccacaaaggcctgggcccgtgggggctgctgcctggcatgacatctctccagatttctggcttaaaaccaactttccatccgagaagcctcctcagtagttactctgctcatgagacagatctgggctccaagccaggaaaggtgaacagaaaccacaagtgtccagccctcggtgctggagtggacgttaattgtcagccaccagactgtcccggcacctacagagaatgtttcacagttctggcatttaaatcctttgatagtggattgtgctgctgttagccttagtttcagtgctttacaagtctcgcttattatctcactggtatttaggtatacaaaacagttgattattcaccacgccaatatctgggtctctgtatctcatgtagaacataagaaaatgggaactaatagggaaatttatttatagcatgaaaataaacctggtggctggagtctgcttgtacggtcaaaaaaaaaaaaaaaaaa

SEQ ID NO: 405 - DNA, 2488 bp, Human
agcaaggggacaggggagtgaggtgagtgagggccaagcaggaacaggggtcacggggcaaggagcacgtggcagcgcaggaaacaggaaggaagcagccaccctcgccatggcctccccgcccgcctgcccctcggaggaggacgagagcctgaagggctgtgagctgtacgtgcagctgcacgggatccagcaggtcctcaaagactgtatcgtccacctctgcatctccaagcccgaacgccccatgaagttcctccgggagcacttcgagaagctggagaaggaagaaaacaggcagattttggcgcggcaaaagtcaaactcacagtcggactcccatgatgaggaggtgtcgcccacccccccgaaccctgtggtgaaggcccgccgccggcgaggaggcgtgagtgccgaggtgtacaccgaggaggacgccgtgtcctacgtcaggaaggtgattcccaaggactacaaaaccatgactgcgctggccaaggccatctccaagaacgtgctcttcgctcacctggatgacaacgagaggagtgacatattcgatgccatgttccctgtcactcacatcgctggggagactgttatacagcaagggaatgaaggagacaacttctatgtcgttgatcaaggggaagtggatgtgtacgtgaacggagagtgggtgaccaacatcagcgagggaggcagcttcggggagctggcgctcatctacggcacccccagggctgcgaccgtgaaagccaagacggacctcaagctctgggggatcgaccgggacagctaccggcgcatccttatgggcagcacgctgaggaaacgcaagatgtacgaggagttcctcagcaaggtctccatcctagagtccctggagaagtgggagcgtctgaccgtggcggatgcgctggagcccgtccagtttgaagatggagagaaaattgtggtccagggagagcctggggacgacttttacatcatcacggagggcaccgcgtccgtgctgcagcgccggtcccccaatgaggagtacgtggaggtggggcgcctgggaccctctgactacttcggggagattgcactgctgctgaaccggccccgggcggccactgtcgtggcccgggggcccctcaagtgtgtgaagctggaccggccccgcttcgagcgtgtgctggggccctgctctgagatcctcaagaggaacattcagcgttacaacagcttcatctccctcaccgtctgagcacagctcccgccctgcagccccagctccccagtgtggtggccgtgccctgctcgtctgtgtcgggggcccgggagccgctgtgtgaggtgtgggccgggtggggctgggtcccggcagcgtgaggactgccccttccccggactcactttttggaataaatgatcaccttgtgcatttccaaatcaaaggacaagcggacaaaatgcatcccaagatcaaggaagggacaggccagcttcctccccacacgcctccccggctgcctctgtgggcttctcctggggggcccaccccacccctgccagtctcctggagatgcttgaggatcggtcctccccagaaccaggccaggacgttgcccctggggcctggtgaccctgtgaggtcaggtcccccagattgaggtctgagtgtgggcaagtgtgtcaaaaggggctgccccccaggggagatgaggctgagagcagggagttgaggccgaagaagtcaaggcccctcccgcaaatgtgtacccctgcccgcgccactgcaccccgccgcacccccacctcccccgggggccctgctgcggatgccggagtgggagagtctctgagctgtgagattgatcttgcccctaattggagaggaagccgggcgccaagacacacggggctcctgccttgggagccagggccgcggccgcaggtagaccccagtagggggggccgggctcgaagttcctttgggaggggctggcgggactccagcaggccgtcctcacctttcttagaaagtccacccagggcaagttgatgttgggggaaagcagaagtcaagccagccgcgggccccacacgccccgacccgctcaaccgacttgtcccttaaatgtgtcttggatcccgcagtgatgacgtgagccagccaggcccgaaagggtgaggccagtgcagagaagcttcccaggggattcctgggttcccccgaaagacaagcgaggtcattgcagttcacctgatgttgctcctgtcccgtgcgtcccggggaggctgtccttggtccgaggctgctcgttgcagcccctcccctgctggcggttacgatgcgtggggtccccctccccacccagccccggccacgtcgccgtgtcccgcctgtgcctgtgacgtccctgtggacctgtgagccatccccccccttatctctgctctgaatactgcatgaagcattaaacgtgcaatgaagtac

SEQ ID NO: 406 - DNA, 3105 bp, Human
gccggggctggggggtgccaaacccacccggcggctgcgccagcgactctgcagctgaagcgcatttggtgaggcggtcgggcgagggagcgcgcacggagcgcgggacggagcgccaggcggacggaccgaaggacggaggcaccgaaggacggacgcccccgcacacgcagacgcacagagctcggcgcggcccccgtcgcatacacactggcacagacacaagcagggacacacgcagacacacgcacactcgcgcgcgcatcctcccgccagcctgcccgcctgctcgccggcgcccggagcccgctctggccgctggatgatctgaagctgccctctctccttcatttatatcaccagcttgctttttgctgagaaagcttcctgccctggaagatggcacccttccccatccagacaccttgggaatgaattatgagggagccaggagtgagagagagaaccacgctgctgatgactccgagggaggggccctggacatgtgctgcagtgagaggctaccgggtctcccccagccgatagtgatggaggcactggacgaggctgaagggctccaggactcacagagagagatgccgccaccccctcctccctcgccgccctcagatccagctcagaagccaccacctcgaggcgctgggagccactccctcactgtcaggagcagcctgtgcctgttcgctgcctcacagttcctgctggaacccacggcctggcttgactctgggacgtggggagtccccagtctgctgctggtctttctgtccgtgggcctggtcctcgttaccaccctggtgtggcacctcctgaggacacccccagagccacccaccccactgccccctgaggacaggcgccagtcagtgagccgccagccctccttcacctactcagagtggatggaggagaagatcgaggatgacttcctggacctcgacccggtgcccgagactcctgtgtttgattgtgtgatggacatcaagcctgaggctgaccccacctcactcaccgtcaagtccatgggtctgcaggagaggaggggttccaatgtctccctgaccctggacatgtgcactccgggctgcaacgaggagggctttggctatctcatgtccccacgtgaggagtccgcccgcgagtacctgctcagcgcctcccgtgtcctccaagcagaagagcttcatgaaaaggccctggaccctttcctgctgcaggcggaattctttgaaatccccatgaactttgtggatccgaaagagtacgacatccctgggctggtgcggaagaaccggtacaaaaccatacttcccaaccctcacagcagagtgtgtctgacctcaccagaccctgacgaccctctgagttcctacatcaatgccaactacatccggggctatggtggggaggagaaggtgtacatcgccactcagggacccatcgtcagcacggtcgccgacttctggcgcatggtgtggcaggagcacacgcccatcattgtcatgatcaccaacatcgaggagatgaacgagaaatgcaccgagtattggccggaggagcaggtggcgtacgacggtgttgagatcactgtgcagaaagtcattcacacggaggattaccggctgcgactcatctccctcaagagtgggactgaggagcgaggcctgaagcattactggttcacatcctggcccgaccagaagaccccagaccgggcccccccactcctgcacctggtgcgggaggtggaggaggcagcccagcaggaggggccccactgtgcccccatcatcgtccactgcagtgcagggattgggaggaccggctgcttcattgccaccagcatctgctgccagcagctgcggcaggagggtgtggtggacatcctgaagaccacgtgccagctccgtcaggacaggggcggcatgatccagacatgcgagcagtaccagtttgtgcaccacgtcatgagcctctacgaaaagcagctgtcccaccagtccccagaatgactgcgcttctcctacaaggttctctgggcactgcccagcctgagtctcggccctcacccagggccctgcctcgggtcctgggcctgctccccgcttcctccccttcagtcagctccctctgtcctctgtcagcctggcctgacccctaccctccagcattgctcttcctactgtacatattggggagtggggggcagggtcgggaagggacatgccaggccaggcctggggccccggggcctgacccacaccacgcagaccccgggctccagtttttaacgatggttccatcaatacctgatccagaatgtttccgtgctacactttgtgtcctgctgcaatgtgttctgtctgtccatccatctctgccctctgtaccggacactgtgtctcctcagccaggaaggggtaatgagctccagcccctaagcaaccggacttgcctgcctcggcctcacccgcacttctcccaaaaggcagatgacggggagttaggcatggggagctccagaaggtcaccagagagctttcagctgagggagagttctctaggttggagtgggcatcacagccagggtggcctctgggtgtcagatgctctcaggagggtgcccagcctgtgaggcactggcaaggtagggggcagatggggcatggagaacccagaggatctaggccctgttggggaggggaggggagctcaaggtttgggtggggactcagcccagatctacgtgagacatttttctgtgtcactgtgggaaagccttcccagaagtctcactgcgtgttgctctgcgtgtgttcccatgtccatgcgtgtgttgagagcccatcaggagggcatgcatgactctttggcaacatgtattatcttggagccacgtgtttttattgctgactttaaatatttatcccacggcagacagagacatttggtgtctttttataattcgctcgtggtcattgaatagagcaataaacggagcattttgagcaaaactaaaaaaaaaaaaaaaaaaaaaaaaaaaaaaaaaaaaaaaaaaaaaaaaaaaaaaaaaaaaaaaaaaaa

SEQ ID NO: 407 - DNA, 1635 bp, Human
cattcaaccgccgctctgcgcggcgccggctccgcccccgtcgggtgtttgtggtggggctgcggagtcgccgatcccgccggaagcgccaggacaatggggacccgggacgacgagtacgactacctattcaaagtggtgctcatcggggactcaggcgtgggcaagagcaacctgctgtcgcgcttcacccgcaacgagttcaacctggagagcaagagcaccatcggcgtggagttcgccacccgcagcatccaggtggacggcaagaccatcaaggcgcagatctgggacaccgctggccaggagcgctaccgcgccatcacctccgcgtactaccgtggtgcagtgggcgccctgctggtgtacgacatcgccaagcacctgacctatgagaacgtggagcgctggctgaaggagctgcgggaccacgcagacagcaacatcgtcatcatgctggtgggcaacaagagtgacctgcgccacctgcgggctgtgcccactgacgaggcccgcgccttcgcagaaaagaacaacttgtccttcatcgagacctcagccttggattccactaacgtagaggaagcattcaagaacatcctcacagagatctaccgcatcgtgtcacagaaacagatcgcagaccgcgctgcccacgacgagtccccggggaacaacgtggtggacatcagcgtgccgcccaccacggacggacagaagcccaacaagctgcagtgctgccagaacctgtgacccctgcgcctccacccagcgtgcgtgcacgtcctccgcccgcccccgccacggtatcctctggcccctccctgctgtccctctgtggccggctcgttccagccctcccagtgagctctgcacggccgggccggggcccaggaaggacaggagccagtgctaccccgtcctgcccggggaaaagctagaagccccggtttgctgcacccatgaaactcgggtccccacagcgtcttggcggggtggggagggcggcaggatggacggggctggccagaggcgaggaggacgggcggacggcgccgccttctccccttttccttggccgactctagggagcgattgcctccctccctctgtgaccgggtggcccagccagcccgtcgtccccacccagaaccgtgctctgggccaaagcccgaagaaccaggcagcgggggccggggcaggcggaccccccgggctctcagcgcccacccgctcctccgcacacagcagctcgcacaggcctcccacctctgcctgttgattgatgcagggagaagcccgtccccccctctcccctctcccctcccctctcctgcacgcaacgcgccctctcggccctccctgtccccctcctctgtctcgtctccccatctggtctggaacctgtttgcaagtgaagcaatatctccgtgttttgtatatacaaccgctcttgtagcctttggtttttgttaatgtagagaaacacagattctttatacactttgtaagatttacgccaaaccccagctctcgatctcttcttctccctgtggcccctgcgctgttgccccgtccccgtcaccccgcccgttactgaaatgtataatctgacttcctgtacagaaaaaaaaa

SEQ ID NO: 408 - DNA, 8665 bp, Human
ccttcccctccccactcttctccttccctcccctcccctcccttcccctccggagcggctggggctgcggcgccgctgctgacacggatcggccgcggccgccaccgggcggaggctgcgcggcgcagacccagacgggcggccccggagggcgcgcggcgatggcggcggcgggcaggcggcgggcgcggcgggcgaggggtccgggctgagctgcgggccggcccggatggcgggcggcgcgggctggtcgggcgcccccgcggctctgctgcgctccgtgcgccgcctgcgcgaggtgttcgaggtgtgcggccgcgaccccgacggcttcctgcgcgtggagcgcgtcgcggcgctcggactgcgcttcggccagggcgaggaggtggaaaaacttgtgaaatatttggatcccaacgacctggggagaatcaacttcaaggacttttgccggggggtgttcgccatgaaagggtgcgaggagctgctgaaggatgtgctgtcggtggagagcgcggggacgctgccgtgcgcgccagagatcccagactgcgtggagcagggcagcgaggtcacaggccccacctttgctgatggcgagctcatccccagggaacccggcttttttcccgaggacgaggaggaggctatgacgctggcgccacctgagggcccccaggagttgtacacagacagccccatggagagcactcagagcctggaggggtctgtcgggagtcctgccgagaaggacgggggacttgggggcctgtttctgccagaagacaagtccctggtccacactccatccatgacgacctcagacctttctacacactccaccacctcgctcatcagcaatgaggagcagtttgaagactatggggagggtgacgatgtggactgtgcccccagcagcccttgccccgatgatgagaccaggaccaacgtctactcggacctggggtcttcggtgtcttccagtgcggggcagacgcctaggaaaatgcggcacgtgtacaacagcgaattgctagatgtttactgctctcaatgctgcaagaaaatcaacctgctcaatgacttggaagcccgactgaaaaacctgaaggccaacagccccaaccgaaagatctccagcacggcctttggacggcagctcatgcacagcagcaacttcagcagcagcaatggcagcaccgaagacctgttccgggacagcattgactcttgcgacaatgacatcacagagaaggtaagcttcctggaaaagaaggtgacagagctggagaatgacagcctgaccaatggggacctgaagagcaagctgaagcaagagaacacacagctggtgcacagggtgcatgagctggaggagatggtgaaggatcaggagaccacggccgagcaggctctggaggaggaggcgcggcgccaccgcgaggcctacggcaagctggagagggagaaggctaccgaggtggagctgctcaatgccagggtgcagcagttggaggaagaaaatacagagcttagaacaacagtgactcggctcaagtctcaaacagagaaactggatgaggagcggcagcgcatgtctgaccgtctggaggacaccagcctgcggctcaaagatgagatggacctgtacaagcgcatgatggacaagctgcgacagaaccgccttgagttccagaaggagcgggaggcgacgcaggagctcatcgaggacttgcggaaggagctggagcacctgcagatgtacaagctggactgcgagcggccaggcaggggccgcagtgcctcctctggcctaggcgagttcaatgccagggcccgcgaggtggagctcgagcacgaggtcaagcggctcaagcaggagaattataagctgcgggatcagaacgacgacttgaatgggcagattttgagcctcagcctctacgaagcaaaaaacctctttgctgcccagactaaagcccagtctctggctgcggagatagacaccgcctcgcgcgatgagctaatggaagccctgaaggagcaggaggagatcaacttccggctgaggcagtacatggacaagattatcctcgccatcctggaccacaatccctccatcctcgagatcaaacactaaggcacggggctggctgcagagcagccttaggaccctgggaccaagggcagaccctgcccaaggatgcaggcctaagccgggcctcacactcacactgtaaatgtctctctggccaccatgcgttacgtgtacccgtgtatatgtggggaggctgtgcacacgagcgaggggtgagtggccgtggctgtgggcagcatccacacggttagccgtgcatgcactttgtggcccctttgcaaggggcagagggtactggaagtgggaggaggcaaggtctgctatcaggagttactgtaaaaacaagaactggaagctcgtgtttccggtactgggtaaaatgattctacctctggggataaggattcacattcgctctagtacgatgggctctttcaccccactcctagtccccttgggagtgggagcaaaattgtgatctttcctaggagtttgaatgccccatatttgtgtcctcgccagctctttggccacctttcaagccccagtgttcaagctcagagaggatgaaggggcatctggagggtccatgagatggggccctcaccaaatgccttggccaccggccagcagccctctgtgatgtgtgtgcagagtgaacagaggactcaggtttcatagcagctagtgcggggcatcctcatcctgtacctatagagttcgtgcactcccccatccatgctacctacctccccgtttctgtttcagttttaagacaatgaagcagcattcactgcgtcattgtaacatgaagggataaaaatgaaggagaaggagggtttgggatgggtgtctaaggcaggagttgacatcgggcaaccaaagaaatgagttttggggaggaacacaactcccatcccagtcagtttccttcccatggctgcatcttaagatggatgcacggagaaaccgtctgcctggctccctgtcttcattctccacgcagcctggtgatggcaggcctgggtttggatttcagaatcctagctccgggctccactcgtgtggcagcaagactgcttcgttccagcgtttagaaacacacctgtatttgattctcagccaggggagcactcgctgcactggtgggaggcggttgggaaagttgcaggaaaaccttagtcttccatccttctgacccatggtggaaattcacaccatggatttttaatggatctttgttctaggcagctgggaatagacatggtacttaccttagagttttccaatttatctcaattttatatggcttgtgattcattttcttaatccaaatatatataaacgtgtgtggtcttattcttccccctgcagtttcttgctttcttcagcacatcttatagtatgagaaggaaggtttgggcatgttgggaagggcggtggagggggagttgcagaaagagagggcagtgagggtgaggagaggggatctggggacttgggtgtgacacctgcttgacagaggcagggctgtggccaggaccaaccttcaattccattccaatcagcctttgcatttgttggatctcgtggcttctttttaatcttttgttggggattagtttcatgctgcacataatggggttgcactggtctgacccaggactttggagccacccacactgggaagactaggctaggcagtcggtcttctaggagtttctcagccccttaggacgcgggtctccttgggctcccccaagggttctgcgaagaggcagtggaagaaggcatgaggagagggtctcttgagaatttgccaataggaaggagtggccacggctgaaaggaacaagacagatcctgacatagctttggcctgggtgttaggtcagaaggagtactggtgcgtgggggccttaccccagggttgagtattttatctgtaaaatgttatctgccctttggctgcattggaatttcagagaaggctgcagaggcctgggttacacagcctgagtcacaacgtgggaaggaatctctgccacgggaaaggtgggcggaagcagctggcagcctggggcgtgcttcaggctcctccctctaaggggcgccatgggaacaggctccggagggagccggcgtctgaaaggcccccgggacctgctgcagtgccagaggggcctctggagcaggcctggcttttaaatggggggctgaattccagctcacacacacctcaagtccaaccttactttcttcagccagaatacatttcttgtaaaacctggcttgttgcttggcttttaaagatggtgtatgtttgtaaaaatattcttctgggctcaaaagctagcttgagggggcagatgccccaggtgtcccagctccacagcccctggcagatcccagaccccttggtggcaggtcccagagcctaggtggtaggagcttgatctttgtttctgcccttacccctcagtagtggggctgcgaggtagtagacaggatgcccagttaagtttgaatttcagatagaaaataattttagaataaatatgttctatctaatacatgggacagatgttatttttagagataggatcttgctctgttgcccaggctggagtgtagtggtatgatcatagctcaccacaaccttgaactcccaggctcaagcgatcctcccgccttaactgcctgagtagctgggactacaggcatgcaccaccacgcccagctaatttttcttattttttgtagagacagggtctcactgtgttgcctcactcgagctgctgacctcaagtgatcctcccacctcagcctgccaaagcactgggattacaggcatgagccaccatgcctggccaggacatatttgaaatggggagattttaaaaattctgatgattagactgaatcctcagacgttctggtttgattgttgtgggtgtagcccaggcatgggattttttaaagagctgctcaggtaattccaatttaattgcgtgtcctacttgggttttttgtttgtttttattgtttttgctaaacctggcaaccctaccgagtagggattagcagtaacttatctgaaatttagaggtgttttgggggtggggcgagggtttctgtagtagactcagattttacatggccctgagctgcccttgcgttcagttggaagccacgcaaaatgaactgaaccaggagtgagcttcgtgtacattatctattagaaaatgaagtaccttctggttcagctagtccctgtgcgttgagaggctttaagaaacttctagtaaaaatgtttttttcttttagctttgaattggccagagtttatcctagattattttattttaaattggtagaattctttgcgaactgtcacagagaaattccttttcatgactttatttctgacctattaaaacatgaacaggccaggcatggtggctcacgcctgtaatcctagcacttgggaggcagtggcaggcggatcacttgagctcaggagtcctaaaccagcctgggcaacatagtgataccttgtctctaccaaaagttaaaaaaaaaaaaaaaaaagctcaagaacctgcacgagggcctaaaacagtgggctcagctttggctgtgcattggaatcacctggggagatttgtaagcttctgctgtctgggctgaacccccagaggttcggattgaattggtgtggggtgtggtccaggcatcgagatgtgtaaagacctccccaggtgatgatatgcagtccgaggttgagactgccctgtcctgcaaggtcgttggccagaggtagaggaaactggtcaaagtggctgttgggcttgtcaagcccgtggctgaatgacagtgagctctcttgctgggagggttccttttcctgttgttgaatggtcctggcctgcaggatgggaggccagatgccttcaggagctggtggatccagctgttctcaccagcctggaggttagcagaccagagtgggtgggcaggaccttggcctggtgcccctggaatcagtgggtggcatgtgttgggatatactggctacaggctcatctcaaagagcaggtagaacagagtcagcagggaactgacaggtggggctgtccccctgaaagcagccgcagaaacagctgccacctatttgcatagctgagcaggaggacatactgtctttgtgggttttgcttctggtctgtttcctgactgggttgataaagggagtcccagctcgttccctgttagccaaaccagcatcctactcacacaccggacactccaggtgctagtccactggtgctggtgttcaggggagttggggggggggggcgcggggacagaagcgcgggttcttggttccaatgagggacttagcagaagcctccaggggccagcagggccaggtgaaactgggagaaatgaagccctctgtgtcctgtgtgtgtggtggggtttaatgcattagcaaatttaaacttaaaaactaactctaggccgggcacggtggctcacacctgtaatcccagcactttgggaggccaaggcaggtggattgcctgagctcaggagttcgagaccagcctggacaacatggtgaaactcttgtctttatttttttaaaaaaacaaaaagtaactttcgatgtgatcataccaggaaagttttgcgtggtcaccatgccaagaaaatgactttggttgcccagcagatccacagcgactctttctcaagggctactgtggattctagattgaggaaaggggccacttaggactcagtgctggtatcctccacagtcctttctcccagactctggccctccctttgggacccaggaaatcccctctagggtgacgctgctggctaggaagactgaggtctgctgcgccaaggggcctcaagttagaagggccatgccgttcagtggatgactttgagcgctgatcctagggacctgccaggtcctcacttcctgccctgggtgcacacatgaatggggcagccagcaggaagcgggagaggctggaaccaggagcctgccctacctgcatggcaggacaactctgaggcccttctgccatattctctgctacccaccagagaaaataggctgccttctagaaagatttgtttctaaaagcgtagaccctggggaagtataatgtcaccatgctcaccaggcgaggtttcccatatgacctccctgccccgacctcgtaggttgctcctttccccatctgtaaggtagagatgtctgccccggagctaccagctggggatggcatccaggccatgtctcctgcaggatccaagtgctgttgtccccagggtgaccctgcctcctgctggggcccatccgctttgctgtgctgcacaggctgttttcatctgcatggtttggggtctttgtccttgtgccttttcttccccatcgccactgtacaggattttccacattgcccactgcctccttttctacatcgtctcatctccctggcctttcccgagccctgtaaatgtgtactttttcaacgtgcctcccccaggtgaggccagctctcccgggcacattcgtccacaaggatcaggccccacttacccttggctcgctcagcctgtagacttggtaactttgtacagaatctttcattattgtcttaagcatggggggctaggacccacttagtccctcctccagcctgcagctaatttaggagccttgcattccagaaaagggcaactttgtgtaaagcagcttctcccacagagctttccctgcattgttagtgatgtcgggcaaagcatcactctttaacctggggcattggccccagcagggatatcatgggaccgcagccgctccgtgcactgtctctgcccccagaggaagccctgtccatggttcctggtgcacggccacaggcctgccttgaggccaccacatctggtgtctagaacagctgcgggccccacttgggcagaaggaagaggtgctagctgctgcccctgcctgctgtgaacacctgcccagcccttccttgtctgctgaggtgctcagaccagagtgccattaaataccaactgatgtcacggagcggacggtgcattgccaaggactcacagctgtgggctcccttccagctcctcccactttcttggctgggtcttctgaggcctacgtggaatgaactacacatgtggcctcatgcccaagggtttgttagatggcctctgactctgtgggattcaacttgacttttttgccccaggaggctctgtctggaaacaggcttagctttagtgctggggtgggacctgccctgtgggccccagggaggggacagtgggggtgaggccctgaggctgtccagggtctgagctctttgcctccaacctgcttctgccccaaaaggaacaggctgttggtggcaggctcctcccggggagctgtactgtacagaccaaggtgtaaataaacagtttgctcttctcgcaaaaaaaaaaaaaaaaaaaaaaaaaaaaaaaaaaaaaaaa

SEQ ID NO: 409 - DNA, 2047 bp, Human
actggccgaggggggcgggcggctggaggagggggtgacggggccccggctcagcacctcggagagctccctccccggccttgttttgctctggcatcgccgccgggggagggagcgagggggccgggcaccgggcgcaaaggcagggggatggccatggaagggttgaggggccccgtcggacagagggcccagccgtgatccagcgacgggtttggggctccgggaggggtgggggggcagcgggcggcggcagcagtggccgcacatctggatggaagcgagctttgtccagaccaccatggctctggggctgtcctccaagaaagcgtcctctcgcaacgtggctgtggagcgtaagaacctgatcaccgtgtgcaggttctctgtgaaaacgctgctggagaagtacacagcggagcccatcgatgactcatcggaggagtttgtcaattttgcagccattttagagcagatcctcagccaccgcttcaaagcctgtgccccagcaggtccagtgagctggttcagctcagacgggcagcggggcttttgggactatatccggctggcctgcagcaaagtgcccaacaactgtgtgagcagcatcgagaacatggagaacatcagcacagcccgggccaagggccgggcatggatccgggtggcactgatggagaagcgcatgtcagaatacatcaccacggctctgcgtgacacccggaccaccagacggttctatgactctggagccatcatgctgcgggatgaagccaccatcctcaccggaatgctgatcggactgagcgccatcgacttcagcttctgtctaaagggggaagtcctggacgggaagacccccgtggtcatcgattacacgccctacctaaagttcacgcagagctacgactacctgacggacgaggaggagcggcacagcgccgagagcagcacgagcgaggacaactcgcccgagcacccgtacctcccgctcgtcaccgatgaggacagctggtacagcaagtggcacaagatggagcagaagttccgcatcgtctacgcgcagaagggctacctggaggagctggtgcgtctgcgcgagtcgcagctgaaggacctggaggcggagaaccggcggcttcagctgcagctggaggaggcggcggcgcagaaccagcgcgagaaacgggagctggaaggcgtgatcctggagctgcaggagcagctgacaggtctgatccccagtgaccacgcccctctggcccagggttccaaggagctcactacacccctggtcaatcaatggccctcactgggaacgcttaatggggccgagggcgccagcaactccaagctctaccggagacacagcttcatgagcacggagccgctgtcagctgaagccagtctgagctcggactcccagcgcctgggagagggcacgcgggacgaggagccctggggtcccatcgggaaggaccccacgccctccatgctgggcctctgcggctccctggcctccattcccagctgcaagtccctggcgagcttcaaatccaacgagtgcctggtgagcgacagtcccgagggcagcccagcactgagccccagctgaggaacagcatgggcagtgccagccccacctgccaggggccatggacacctgccacctttcttcaacaagagtcccccaatccaggctacccttccagagaacgctacccacccagccagggttctctcggggaagatctcgtctgctcaccttagctttctgccttggcagcacgggctgcggaagaaagcacgctgggccaggaggcaggggtgcccaagccacagggagcccctggggaagcctgctccattcttctggtgaccttggcgctccttcactcatctcccctgccccctcaggaactggtggcccagcttccacacccccacctcccagtctctagcctctccatctgtctgtgtatggcctggagtcactccttcctcagcccccagggcaagagagctcaaataaaaaccagaggactga

SEQ ID NO: 410 - DNA, 2441 bp, Human
cttcccccgcccccgcagtctctctctctctctctctccttcccccaaccctccctccctcctccccccgctccttcccccaaccctctctctctctccctctgtctccctccctctctctctcccgccgcgcccgcctcccgcccgccctcgctccctccactcctctcccctcccctccccggcactgcagcaccagccgtctgcagctccggccgccacttgcgcctctccagcctccgcaggcccaaccgccgccagcaccatggccagcaccatttccgcctacaaggagaagatgaaggagctgtcggtgctgtcgctcatctgctcctgcttctacacacagccgcaccccaataccgtctaccagtacggggacatggaggtgaagcagctggacaagcgggcctcaggccagagcttcgaggtcatcctcaagtccccttctgacctgtccccagagagccctatgctctcctccccacccaagaagaaggacacctccctggaggagctgcaaaagcggctggaggcagccgaggagcggaggaagacgcaggaggcgcaggtgctgaagcagctggcggagcggcgcgagcacgagcgcgaggtgctgcacaaggcgctggaggagaataacaacttcagccgccaggcggaggagaagctcaactacaagatggagctcagcaaggagatccgcgaggcacacctggccgcactgcgcgagcggctgcgcgagaaggagctgcacgcggccgaggtgcgcaggaacaaggagcagcgagaagagatgtcgggctaagggcccgggacgggcggcgcccatcctgcgacagaacacgttcgggttttggttttgtttcgttcacctctgtctagatgcaacttttgttcctcctcccccacccccgcccccagcttcatgcttctcttccgcactcagccgccctgccctgtcctcgtggtgagtcgctgaccacggcttcccctgcaggagccgccgggcgtgagacgcggtccctcggtgcagacaccaggccgggcgcggctgggtcccccgggggccctgtgagagaggtggcggtgaccgtggtaaacccagggcggtggcgtgggatcacgggtccttacgctgggctgtctggtcagcacgtgcaggtcagggcaggtcctctgagccggcgcccctggccagcaggcgaggctacagtacctgctgtctttccagggggaaggggctccccatgagggaggggcgacgggggaggggggtgatggtgcctgggagcctgcgtgtgcagccggtgcttgttgaactggcaggcgggtgggtgggggctgcagctttccttaatgtggttgcacaggggtcctctgagaccacctggcgtgaggtggacaccctgggccttcctggaagcctgcagttgggggcctgccctgagtctgctggggagtgggcattctctgccagggacccatgagcaggctgcatggtctagaggttgtgggcagcatggacagtcccccactcagaagtgcaagagttccaaagagcctctggcccaggcccctccccaccagggctttgcagatgtccttgaaagacccaccctagagccctttggagtgctggcccctcctgtgccctctgccctggtggaagcggcagccacaagtcctcctcagggagccccaagggggattttgtgggaccgctgcccacagatccaggtgttggaagggcagcgggtaaggttcccaagccagccccaacacccttcccacttggcacccagagggggctgtgggtggaggcctgactccaggcctctcctgcccacaccctctgggctgagttccttctttcccttggacgcccagtgctggccttggaggacggtcagctggaggatggcggtgggggaggctgtctttgtaccactgcagcatcccccacttctccacggaagccccatcccaaagctgctgcctggccccttgctgtaaagtgtgaagggggcggctgagttctcttaggacccagagccagggccctcaacttccatcctgcgggaggccttggccgggcactgccagtgtcttccagagtcacacccagggaccacgggaggatcctgacccctgcagggctcaggggtcagcagggacccactgccccatctccctctccccaccaagacagccccagaaggagcagccagctgggatgggaacccaaggctgtccacatctggcttttgtgggactcagaaagggaagcagaactgagggctgggatattcctcatggtggcagcgctcatagcgaaagcctactgtaatatgcacccatctcatccacgtagtaaagtgaacttaaaaattcaatcaaatgaacaattaaataaacacctgtgtgtttaagacatggtt

SEQ ID NO: 411 - DNA, 2352 bp, Human
gagcagtggtgctgatgttgagagaagcccagggtaccactaattgagggagtgaggaagagagcagctcgcttctaactggactgcacgttggtgacagcgtcccaagctggtgacagacccactctgtaactttcagctagattcagccaccagatcccagaaacatgacccttgctgcctacaaagagaagatgaaggagctcccgctggtgtccttgttctgctcctgcttcctggccgatcccctgaataagtcgtcctacaaatatgaaggctggtgtgggagacagtgtaggaggaaggatgaaagccagcggaaagacagtgctgactggagagaaagaagagctcaggcagacacggtggacctgaattggtgcgtcatttccgacatggaagtcatcgagctgaacaaatgcacctcgggccaatcctttgaagtcatcctgaagccaccctcctttgatggggttcccgagttcaacgcctccctgccaaggcggcgagacccatccctggaagagatccagaagaaactagaagcggctgaggagcgaaggaagtaccaggaagcggagctcctgaaacacctagcagagaaacgggaacatgagagagaggtgatccaaaaggccattgaggaaaacaacaacttcatcaagatggctaaggaaaaactggcccagaagatggaatccaacaaggagaacagggaggcccacctcgccgccatgttggaacggctgcaagagaaggacaagcacgccgaggaggtgcggaaaaacaaggagctgaaggaagaggcctccaggtaaagcctagaggccaaagaactttccaggtcagccggacagctccagcagctccacgttccaggcagcctcgcccgccggctgcgctcccagcactggggtttggggggaggggggtggccaaggggcgtttcctctgcttttggtgtttgtacatgttaagaattgaccagtgaagccatcctatttgtttccggggaacaatgacggggtgggagaggggagaggagagagtttgggaaagggagatggagaagaactcaaggacattgcaaccctgcccggcgcagatctgattttcacatctctacctggacattgagcctccaggcaccatgttgaggagagatgaaaaccagggcggtagaacttcagggtgaaggacagagtcctgggtggggcagcggctgcagggcgcaccagagaacccagccagaggggttgtgagtaccagtggtgttgcttccaccctgcagcaggtgggatgaggtctgtgtgtgtgtgtgaaccatcattttttgatcatcatgaccaatgaaacattgactccaagtgtccagttctttatttcccaaatgtgtcctttgggtaattgttaaaaagttctcgaaacctggctttcatccatctgatggcagatgcccctttgcttccttaattctgccattcaagcatctggagcctgggtgaggtgggttgaatcaggccagcctttggcataattgaaaggttttctcttctgttttttaaaatcccctctgtgggctaatctttattggatagcatgcactaaattgatgagaaaagaaactcaatcttcctttcaatgaactgacatcctaatatggtccccaagatgcactgtaagaaggaatttgtcttagtcacaaccgttcagactgctgtaacaaaataccttagactaagtaattgataacagaaattgattgctcacagttttggaggctgggaagtccaatatcaaggtgccagcagattcagtgtctggtgagggcttgccatctgcttcaaagatgatgcctttttgctgcatcctcacatggcagaagggaagggcaaaagggcttccttgagccttttctttaaggcactaatcccattcatgaaggtggagtcctcatgatctcacctcttaaggccctatctcttaattctgtagtgtcgggattaggattcaacctgtatattgggggagacagcaacattcacaccatagcagaagtcctccatgctttgggggtttgagattctaggtagattagaaaatacgagcaaggaaataaagtgtttgctagtagaaggcaaaggaggcatccagacccagcagtcttggtctccaggacactgaaccatggctggaaaagaagctctcctcctcccttcccctgcaaacatgagtgcaggggctgcctgtgttaaccgggtcccaggacctcttcccactctgctctgcacactgtgtagttttttacagctttgcaaataaaccctttggtatagcctttaaaaaaaaaaa

SEQ ID NO: 412 - DNA, 2522 bp, Human
accccaacgccgcttctgcggccaaagtaggttgggagtggaaggtggtggctgctgctccgcagtgtcgggaagatggcgccgccggtggcagagagggggctaaagagcgtcgtgtggcagaagataaaagcaacagtgtttgatgactgcaagaaagaaggcgaatggaagataatgcttttagatgaatttaccactaagcttttggcatcgtgttgcaaaatgacagatcttctagaagaaggtattactgttgtagagaatatttataagaaccgtgaacctgtcagacaaatgaaagctctttatttcatcactccgacatcaaagtctgtagattgtttcttacatgattttgcaagtaaatcggagaacaagtataaagcagcatatatttacttcactgacttttgccctgataatctctttaacaaaattaaggcttcttgctccaagtcaataagaagatgtaaagaaataaatatttccttcattccacatgaatctcaggtgtatactcttgatgtaccagatgcattctattactgttatagtccagaccctggtaatgcaaagggaaaagatgccattatggaaacaatggctgaccagatagttacagtgtgtgccaccttggatgaaaatcccggagtaagatataaaagtaaacctctagataatgccagtaagcttgcacagcttgttgaaaaaaagcttgaagactactacaagattgatgaaaagagcctaataaagggtaaaactcattcacagctcttaataattgatcgtggctttgatcctgtgtccactgtcctgcatgaactgacctttcaggcaatggcatatgatctactaccaattgagaatgatacatacaaatataaaacagatggaaaagaaaaggaggccatccttgaagaagaagatgacctctgggttagaattcgacatcgacatattgcggttgtgttagaggaaattcccaagcttatgaaagaaatttcatcaacaaagaaagcaacagaaggaaagacatcacttagtgctcttacccagctgatgaaaaagatgccccatttccgaaaacagattactaagcaagttgtccatcttaacttagcagaagattgcatgaataagttcaagcttaatatagaaaagctctgcaaaactgaacaggacctggcacttggaactgatgcagaaggacagaaggtgaaagattccatgcgagtactccttccagttctactcaacaaaaatcatgataattgtgataaaataagagcaattctactttatatcttcagtattaatggaactacggaagaaaatttggacaggttgatccagaatgtaaagatagaaaatgagagtgacatgattcgtaactggagttaccttggtgttcccattgttccccaatctcaacaaggcaaaccgttaagaaaggatcggtctgcagaagaaacttttcagctctctcggtggacaccttttatcaaagatattatggaggatgctattgataatagattagattcaaaagaatggccatattgttcccagtgtccagcagtatggaatggttcaggagctgtaagtgctcgccagaaacccagagctaattatttagaagaccgaaaaaatgggtcaaagctgattgtttttgtaattggagggatcacatactctgaagtgcgttgtgcttatgaagtttctcaggcacataaatcctgtgaagttattattggttctacacatgttttaacacccaaaaagctgttggatgatataaagatgctgaataaacccaaggataaagtctccttaattaaagatgaatagcatttctttttggagggtttagagattcttactaatatgttgaactaaaatagaaagaaaatgttgctgtcatgtaatttaaacaatgtaaatattttatggaataatggcttttcaaatacatttcttaaggaactgtttatgattattactggatttgtcatttttgataatttaaatattgctgctgctttgtagatgatgagaagaaatgttaaagtgctttctaaaaggaaattttttcacctttggaggagaatatattagagttgtgggtaatttttcacagccacctatgtacatactaattacccattggatacttatatctaaaagtctcatgctgaagtatagtttttgggaaagaatgattttaaataaagagattgtaaaagtaaaaaactgtaaatgtatatgtatgatagaattgtttcctctaagtgtagtttttctttcaactaaaattcagtttatgtgtaaaataattcagtcattaatagaaatggagtgatttcacagtgtgtactgttttgccacatacttctaaagaacacaattttatataattttgaaatcatgtatgtttaaattagaaaaccaaaaatcatgaacattctaagagaaaataaatatagaatttaaaaaattaaaaaaaaaaaaaaaaaaaa

SEQ ID NO: 413 - DNA, 1452 bp, Human
gcattgcgcaggcgcgctgcctggagtcctgcccccagcggcggttgctccaatcaccactggaggctccctcccgaggcaccctcgctggcgagctgagaggaaatggcggggaggtccctgacatcgaaggccgagcccaccgcaggagccgtggacagggctgagaaggccggagggcaggacacgtcctcacagaaaattgaagacttgatggaaatggtgcaaaagctgcagaaagtgggaagcctagagccccgagttgaggtcctgattaaccggattaatgaggtccagcaagcaaaaaagaaagccaataaagacctaggagaggcccggaccatctgtgaggccctgcagaaggaactggactcgctgcatggagagaaagtacacctgaaggagatcttgagcaaaaaacaagagaccctgaggatcctccggctgcattgccaggaaaaggaaagtgaggcacacaggaagcacaccatgttgcaggagtgcaaggagagaatttctgccctgaacttgcagattgaagaagagaagaacaaacagagacagctgaggttggcattcgaggaacagctggaagatctgatgggccagcacaaggacctctgggacttccacatgccagagcggctggcaaaggagatttgtgccctggacagcagcaaggagcagctgctcaaggaagagaagctggtcaaggcgacactggaagacgtgaagcatcagctgtgctccctgtgtggggctgagggcccctccacccttgatgagggactctttctccgcagccaggaggctgcagccacagtgcagctgtttcaggaagagcacaggaaggctgaggagctcctagcagctgctgcccagcgccaccagcagctgcagcagaagtgccaacaacagcagcagaagcggcagaggctgaaggaagagctggaaaagcatggaatgcaagtccctgcccaagcccagagcacacaagaggaagaggctggcccaggagatgtggctcccagaccaggtagaccagtgacatggtggagttgaagagagaggctcactgcagagcactgtttccatggaaaaatggaacatggcaaagtgcagaaattcttcagtcagtccaggacagacgagttctctaagatgcagttaatcatacctgtcttaaacaaactggcaatatactatcaaacatgacttttaaatcaagtggaagttagaaaatatattgaactgagtggcaatgaagacaccacattttaaaactgtaattcagttaagcccacaattagaaggaactttagcttttattggttcaccacaattttttaagaaatcaaccaatgattgttcagttaatgaataaaaggcctttgacacagttcacctattcatgtgaaaaaaaaagactaataaatagtcagcttcccttag

SEQ ID NO: 414 - DNA, 4449 bp, Human
ggccagcgtcggttgccgccttagcgggcgcctccttttcatccctcatccttcatccctggctttcgcgctctagcggagtgggatctgcgaacacgtgaggcgggggcgcggtccccaggctgccgagatggccctgagcgacgaaccggccgcgggcggccccgaggaggaggcggaggacgagacactggcctttggcgcggcgctggaagcgttcggcgagagcgcggagacccgggcgctgctgggccgcctgcgggaggtgcacggcggcggcgcggagcgcgaggtggccctggagcggttccgcgtaataatggacaaataccaggagcagcctcatctgttggacccgcaccttgaatggatgatgaacttgttgttggacatagtgcaagatcagacatctccagcttcccttgtacatctggcttttaaatttctttacatcatcaccaaggttcgaggctataaaacatttcttcgtttatttcctcatgaagttgccgatgtagagcctgttttagatttggtcacaattcagaatcccaaggaccatgaagcttgggaaacccgctacatgcttttgctctggctctccgtgacctgcctgatcccttttgatttttctcgccttgacgggaacctcctcacccagcctgggcaagcacgaatgtccataatggaccgtattctccaaatagcagagtcctacttgattgtcagtgacaaggcccgagatgcagctgctgtccttgtgtccagatttatcacacgtcctgatgtcaagcaaagcaagatggctgagttcctggactggagcctgtgcaatctggcccgttcctccttccagaccatgcagggggtcatcaccatggatgggacgctgcaggccctggcacaaatatttaaacatggaaaacgtgaagactgtttgccctatgctgccactgtcctcaggtgcctcgatggctgcagactccctgagagcaaccagaccctgctgcggaagctgggggtgaagcttgtgcagcgactggggctgacattcctgaagccgaaggtggcagcatggaggtaccagcgtggctgccgatctttggctgcaaatctgcagctcctcactcagggtcagagtgagcagaagccactcatcctgaccgaagatgacgacgaagatgacgacgtcccagagggggtggagcgtgtgatagagcagctgctggtcgggctgaaggacaaggacacggtcgtgcggtggtctgcagccaagggcatcggtaggatggctggcaggcttcccagagccctggcggatgatgtggtcgggtctgtgctggactgcttcagtttccaggagactgacaaggcgtggcatgggggatgtctggcgctggcagagctgggcaggagaggcctgttgctgccgtctcgactcgtggatgttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagtgttctgcgagatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaagaagttcctgccttttgtctctgagcctgatgtgtgtaggggtgatggaaaggctcactgcccaggggtcagccagaggggaggtgggctgcactcctcctgcctggagaccaggcccccttcttgcctggtgctgtccctgctgtgggagacgtctggccacaggcagtgccccacccagtcttggagagagatgaatgttaaatcagaggttcaaatgctagagaactgagaagccctggtggcaggcatggtctggagtgctgggcagatgctgtttctgggcccgtctgcctggtgggggtgctgtcctcccccctgtgcacacgtgagcatcgtgcatgtggcccctctgcagtgcaggagtcactgattgatgggtgtgccgaccagcagcttcacaaatgtctgctgcaaggggaatcgtcagagtccaatgtgtgcctctacagtaatgtcggaaataaataccattcttgaaataaaaaaaaaaaaaaaaaaa

SEQ ID NO: 415 - DNA, 6895 bp, Human
gtagatttggttgctgtgtacgtggaagaagcaagcgcatgcgcacatgggcccccttcgtctcagctgtgcgggaacggccgagggtaacatcccgggctcgcgggaggctgtcggggtaatggccacacgctgacagaaccagccgagtggaaaaggggagcgaagccgttcctctgcacccttccccaggcctgaggccttcccgcttggtgctgccgccgccactgccggctgaggaggggcgatgagttggttcaacgcctcccagctctccagcttcgctaagcaggccctgtcccaggcccagaagtctattgacagggttctggacatccaggaagaggagccgagcatctgggccgagaccattccgtatggagagccgggaataagttcccctgtcagtggaggatgggatacttcaacctgggggttgaaatcaaacactgaacctcagagtccaccaatagcctctcctaaagcaatcacaaagccagttcggaggactgtggtcgatgaatctgaaaatttcttcagtgcctttctctcgccaactgatgtccagaccattcagaagagtccagtggtatcaaaacctccagcaaaatcacaacgaccagaagaagaagtgaaaagcagcttacatgaatccttgcacattggccagtcaagaactcctgaaacaactgaatcacaagtaaaagactcttctttgtgtgtttcaggggaaactctggcagcaggtacttcatcacctaaaactgaaggcaagcacgaagaaactgttaataaagaatcggatatgaaggtgccaactgtaagtttgaaagtatctgaaagtgtaattgatgtgaaaacaactatggaaagtatatctaatacgtctacgcagtctctcacagcagaaacaaaggacatagctttggaacctaaggaacaaaaacatgaagacaggcagagcaatacaccttctcctcctgttagtaccttttcatcaggtacttctaccaccagtgatattgaagttttagatcatgaaagtgtaataagtgagagctcagcgagctcgagacaagagactacagattcaaaatcaagtcttcacttgatgcagacatcttttcagcttctctctgcatctgcttgtcctgaatataatcgtttagatgatttccaaaaactcactgagagttgctgttcatctgatgcttttgaaagaatagactcatttagtgtacagtcattagatagccggagtgtaagtgaaatcaattcagatgatgaattgtcaggcaagggatatgctttagtgcctattatagttaattcttcaactccaaagtctaaaacagttgaatctgctgaaggaaaatctgaagaagtaaatgaaacattagttatacccactgaggaagcagaaatggaagaaagtggacgaagtgcaactcctgttaactgtgaacagcctgatatcttggtttcttccacaccaataaatgaaggacagactgtgttagacaaggtggctgagcagtgtgaacctgctgaaagtcagccagaagcactttctgagaaggaagatgtttgcaagacagttgaatttctgaatgaaaagctggaaaaaagggaggctcagttattatctcttagtaaggaaaaagcacttctagaagaagcttttgataacctgaaagatgaaatgttcagagtgaaagaagaaagcagtagcatttcttccttgaaagatgagtttactcaaagaattgcagaagcagaaaagaaagttcaactagcctgcaaagagagagatgctgctaaaaaggaaatcaaaaacataaaagaagaacttgccactagattaaatagtagtgaaactgcagaccttttgaaagagaaagatgagcagatccgagggttaatggaagaaggagaaaaactttcaaaacagcagctgcacaattctaacatcatcaagaaattaagagctaaagacaaggagaatgaaaatatggttgcaaagctgaacaaaaaagttaaagagctagaagaggagttgcagcatttgaaacaggtccttgatggcaaagaagaggttgagaaacaacatagagaaaatattaaaaaactaaattccatggtagaacgccaagagaaagatcttggccgtcttcaggtagacatggatgaacttgaagaaaagaaccgaagtattcaggctgccctggatagtgcatacaaagaacttactgatcttcacaaagccaatgctgcaaaggatagtgaggcacaggaagctgctctgagccgtgaaatgaaagctaaagaagaactttctgcagcattagagaaggcccaagaagaagcccgtcagcagcaagaaacattagccattcaagtgggggaccttaggcttgcattgcagcgtacagaacaagcggctgccagaaaggaggattatttacgccatgagatcggtgaacttcagcagagactccaggaagcagagaatcgaaaccaggaactgagtcaaagtgtttcatcaacaacaagaccattgcttcgacaaatagaaaatttgcaagcaaccctgggatcccagacatcgtcgtgggagaaattagagaagaatctttctgataggcttggtgaatcccagaccttgctggcagcagcagttgagagagaacgtgcagctacagaagaactccttgctaacaaaattcagatgtcttccatggagtcacagaattctcttttaagacaggaaaacagtagatttcaagcccagctagaatcagagaaaaataggctgtgtaaactggaggatgagaacaataggtaccaggttgaattggaaaacctaaaagatgaatatgtaagaacacttgaagagacgaggaaagaaaagacattgttgaatagtcagttagaaatggaaagaatgaaagttgaacaagaaaggaagaaagccatttttactcaagaaacaataaaagaaaaggaacgcaagccattttctgtttctagcactcccaccatgtcacgctcaagttcaataagtggtgttgatatggcaggactacagacatcttttctgtctcaggatgagtctcatgatcactcatttggaccaatgcctatatcagcaaatggaagcaatctttatgatgctgtaaggatgggagcaggatcaagcataattgaaaacctacagtctcagctaaagctaagggaaggggaaatcactcatttacagctagaaattggcaatctagaaaaaactcgatcaataatggctgaagaactagttaaattaacaaatcaaaatgatgaacttgaagagaaggtgaaggagatacccaaacttagaactcagctaagagatttggatcaaaggtacaacactattctgcagatgtatggagaaaaagcagaagaggcagaagaacttcgattagatctcgaagatgtaaaaaatatgtacaaaactcaaatagatgaacttttaagacaaagtctcagttaacttgtgaaaattgaattcccatcaaactgaatgtaagcatttaatatctaaacatttaatgtggacttccaataaattcttttatagaattagaaagtgggatttactgtagagtgtaaaaatttttttaaaattgttttacactatgtagtaatatttacagttaaattattttgtgcaatatttgaactttatttttgaaactattctttaaagatttattttttaaagcattcattttttttccttgaatagcacagagatttattactttatcctcatataaatatggctagagaagaagaatggtgttcatatatgtattgtagatatacaactagttgtatctataatttgtaagtgtttatatatatattaagaacatttgaagagtaatgttaacatactgaaactttgaaatctttcacatttaaaatttcaacatatcttaattactgctcatgaaaatgtacattaagtgttaaagtaaaaaattattaaatctgtggctattaaattttaaactaatttttttcctttaaaagtaagagtcacactgacactgtctgaaatttaaagagtgaatgatttaaacttaaaaaaaattttgatctgaaaatttatttcacccagctttcacaattaagtctgtataaaatgtggtaccttttggtacctatccagagaaacctgtacatattcaatgttatctagatgtgattggataatggagaaaatttatttataatgattttgcaatggcatcaataacatttaaatgattttgaagaagtattattttactaccctataaaatgaatcgaaaataataaagttcttaacataatttactctttaaaaattacctgttcatattttgtaaacccatatttttagcacattaaaaatgaatgtttgatattacagaatattcataacaaaatggaagaattataggaattaacttgaatttggcatttttaattttgtgatttatcattttattttttcttgaaatttcaaacacaaggaaagcatagaatagcttttaaaagtagctatgccttcttccaaatgttattttattcaaaaaggtaaccaggttgtgttttaaacctgtgaaatattgtgatgcattttattactgaaagttatttaactgcctttacttgcacataaaaactctcatttacggccaggtgctgtggctcatgcctgtaatcccagcactttgggaggccaaggcgggcatatcacctgatgtcaggagttcaagaccagcatggccagcagtttggtgaaaccccatctctactaaaaatacaaaaattagcctggcgtggtggtgtgcgcctgtaatcctagctactcgggaggctgaggcaggagcattgcttgaacctgggaggtggaggttacaatgagccaagattgtgccactgcactccagcatgggtgacagagaaagactccgtctcaaaaaaaaaaaaacaaactcttatttaatttttagttaaaattaaaacactagtacttcagaatatagatacaagtacaccatcttgaagaatttggagtttttcagggcaattcaaatgacctcattttttgttctttttgtattccagacagtgtttctgtcattggatctctgattggtagtgttaataaatattctttcagtgtgagccagattcataaaattaattttcttcattttagtagtaaaaagtagtctaatagctttttgtcagcttgatttttttgtgtgtgtaatattcaagggcagaatgacaggacagataagcaataagaaatgtatagaattagaaaatatagtagttccctcttacccatgggacatacgttccaagacccccagtgaacgtctgaaaccatggatagtatagacacctctatacactgttttttcctatacatatatacctatgataaagttctatttataaatcagggacagcaagagataaacaataactgcaaatagaacaattataacagtgcactgtaataaaagtgatgtaaatgtgatatgtctgtctctttctctcaaaatatcttattgtactgtactcacctgtaatcagactgtggttgaccgtgagtaaccgaaaccacagaaagcaaaatcgtggataaggggagactactctatatgaaacttaagttacaaaattctctgaagcatttgaaactagacgttttggaattataaaatagtccctttaaaatatccactagtagaaaaaaacttcatttgcagagaaaagattgcaataaaactcattcctaaacttttcaattttataaaattaaacattctttttttatccgtattaacaatttctagttacatagtttctagttacatattaccatatattactctttatctacaaataaatagctgatactcaaactgatcatattttgattgttaaacacttggatctctcaatacttctgtaagttaaagtgaacttaaacagtttcttgaaaaactccagtaggtggcagaatacctattgaatattcgttgctatactttgctgtttgtcattaaaacatctctacccatattcttgcaaaataatatttatattttaatggataggaaaatgatttgcaattagatgtttccattcttgaaagaaaaaagctgcaaataacattttcaagaatataaaaaaatgagtaaacaaagggaaggttgtttggtcatttatagacaattaagcacagactgtagatgtccttccaattcttgggaggctaaactgagtctaccatttcttacatttcttttacctattttttgagaattgccagttgtacagtgtttagcatgtggaatgtaccaaatatatctatgttgtgacttaagatattctaaatgtggataacttctgacctaggaaacatgaagtttgtagtgaagtaagtgaaaagaatgttcaggaaattttttttctccatctcttcagttggcatttattgagagttttatttgaatgcttattaaaagtatatgatttataatatttagaaaatagaagaaaaaagaaaactgtagatgttttatcttgttttaatactgtatgtttagtacgtatacatttatgttctagtgtatcaaaatttttcattttcattaaagtgaatccaattttccatattctaggtccattttaaaccatgaaaactttaatcacatattttgtaaagggctgaaagtatgatttaaactacagattgatatattttaattctaaatgaaaggtaatgtaaataagcatggatctgattgaataaagattttaaaatagtaaaaaaaaaaaaaaaaaa

SEQ ID NO: 416 - DNA, 1951 bp, Human
gtaggtttgttgcctcaccagtgcgcccgccggagggtgtttatcgcggctagagagatgtcgctgctgcggtcgctgcgcgtgtttctggtcgcgcggaccgggagctacccggctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacaggcagagatctggctccacaaggaggcccagaaggagggctggagcaaagctgccaagctccaagggaggaagaccaaagaaggcctgattgggctgttgcaggaaggaaacacaactgtattagtagaggtaaactgtgagacagattttgtttctagaaatttaaaatttcaactgttggtccagcaagtagcccttggaaccatgatgcattgtcagaccctaaaggatcaaccctctgcatacagtaaagaaaactgggagaaaacatgattcttaaacgagctgcatgggtgaaggtgccatctgggttctacgttggctcttatgtccacggagcaatgcagagtccctcacttcacaagctggtgctggggaagtatggggccctggtcatctgtgagacgtctgaacagaaaacaaaccttgaagacgttggccgccgccttgggcagcatgtggtgggcatggcccccctctctgttggctccctggacgatgagcctgggggagaggcagagactaagatgctgtcccagccgtatttgctggatccctccattaccttggggcagtatgtgcagcctcagggggtgtcggtagtagactttgtgcggtttgaatgtggagaaggtgaagaggcagcagaaactgaataggttccagagacttttggcccaggaggaatatttacttttagctctggacatcattacaaaaaggaatatttcccaaacctcttcagaccgagaatgcatgggtaaaattattaaatagttgtataataaaaataattttttccttgtttgcgtaatactggatttagcttttctgtgcctttcaaaaacaacaggtgggccttattgacgtgatagtgtcgtggagaacaggcatcaacaatactgctgctcccttcaacatagatttattatggtatttctgaaatttctaacttatatgttctgtcttacaccttttatgacatagaactcttttgttctgtttttgctttgcgacactgtgaaccgtgcttctgcctcggaacctccctagttatattacttgtgccacatggatttctttaggattattgattcaaacctagagttgtctggaaaatgtgggttctcttctttgtgattgtctgtagtatgctttgaaggtgctctgcagtggtagacacactggttctggcctcatttaatgaaattaataacacatgcccctatttctcttttggatgatgtgtgggtgggtgggtactgaggtttcctggccagctgtaaggcagattttgacattcttgtgccagaaacagaaattagagtagtccagttacccagagagctcacttaacattgcctctttacttccccagtactgaaacatttcttcaagtataacataaaattaccgtaacaagcagacccagaatactgaaaataactccatttgttcattataggtatctttatttgaaaagtgaaaaatgctttgacacattacagatctgggtatttggattttgcctatggagtgcatatatgatttcaatgatttacaggctaaatagattttagaaataatcatcttaaaattgaaaacaaaggtaggtcctggtataatattaaacataaagttattaaacattttaagcattgtt

SEQ ID NO: 417 - DNA, 3869 bp, Human
agttcccacagggccttgtgcgacatgggctgcgccgagggcaaggcagtggcggcggccgccccaacggagctgcagacgaaaggcaagaacggcgatggccgccgtaggtcagctaaagatcatcaccctggtaaaactttgccagagaacccagcaggattcaccagcacggccactgcagactccagagccctgcttcaggcctatatagatggtcactctgtggtcatcttcagtaggtccacatgcacacgctgtactgaggtaaagaagttatttaaatctctgtgtgttccttattttgtgcttgaacttgatcaaacagaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataatatccacgtgtgccttcttactgaaaaaaaaaaa

SEQ ID NO: 418 - DNA, 3223 bp, Human
cggcggcggcggcggcggcggcggcggcggagcccggagcgcaggccggaggctcccggcccgccggccccggagcggagcggagcggaggatgcagcagccgcagccgcaggggcagcagcagccggggccggggcagcagctggggggccagggggcggcgccgggggccgggggcggcccaggggggggcccggggccggggccctgcctgaggcgagagctgaagctgctcgagtccatcttccaccgcggccacgagcgcttccgcattgccagcgcctgcctggacgagctgagctgcgagttcctgctggctggggccggaggggccggggcgggggccgcgcccggaccgcatctccccccacgggggtcggtgcctggggatcctgtccgcatccactgcaacatcacggagtcataccctgctgtgccccccatctggtcggtggagtctgatgaccctaacttggctgctgtcttggagaggctggtggacataaagaaagggaatactctgctattgcagcatctgaagaggatcatctccgacctgtgtaaactctataacctccctcagcatccagatgtggagatgctggatcaacccttgccagcagagcagtgcacacaggaagacgtgtcttcagaagatgaagatgaggagatgcctgaggacacagaagacttagatcactatgaaatgaaagaggaagagccagctgagggcaagaaatctgaagatgatggcattggaaaagaaaacttggccatcctagagaaaattaaaaagaaccagaggcaagattacttaaatggtgcagtgtctggctcggtgcaggccactgaccggctgatgaaggagctcagggatatataccgatcacagagtttcaaaggcggaaactatgcagtcgaactcgtgaatgacagtctgtatgattggaatgtcaaactcctcaaagttgaccaggacagcgctttgcacaacgatctccagatcctcaaagagaaagaaggagccgacttcattctacttaacttttcctttaaagataactttccctttgacccaccatttgtcagggttgtgtctccagtcctctctggagggtatgttctgggcggaggggccatctgcatggaacttctcaccaaacagggctggagcagtgcctactccatagagtcagtgatcatgcagatcagtgccacactggtgaaggggaaagcacgagtgcagtttggagccaacaaatctcaatacagtctgacaagagcacagcagtcctacaagtccttggtgcagatccacgaaaaaaacggctggtacacacccccaaaagaagacggctaaccctggagtatcacccttcctccctccccaggcaccactggaccaattacctttgaatgctgtatttggatctcacgctgcctctgtggttccctccctcatttttcctggacgtgatagctctgcctattgcaggacaatgatggctattctaaacgctaaggaaaaaaaacaaacacagaactgtttcaagtactcaagactgacttacagaccaaccaaccaccttgctggaacccttgctagcaggcattcttataaaagaaactttcgagcctccttatattgctggaaactcagctgtgctccagactagagcctccttacctatgctatggatttttaatttattttctcttatttcatgtacactgctttttttggttacagtgtatgatggatgtgtatgaaaaaaatgtatctttgggaaaacaattacagtttgttaatttgaagatgctggtcttgactcatctttatttttattcgcacatcccaccccatcccctgaactacttgggaggtggggaggggtacgagtccactgttgctttggtagagatgagaggccgcattttgctgctaaagcaagagaaacttggagctgaagcacacacctggtctgcccctagatttctcctcaaggcctctggagcaaccagcacttgcccccttggaatgcagagcctggcctgccaaactacaatgtggtaggctgaaacgatggtgttaattcttaggactacttttctagtcacagatgttttcaaatttctaagaaaaagaaaatgaggctcaagaggctgcttcgtagaattccttttgaatgaattgagtggggatggggacacagtctccaagtgtgtatgtggtcttttctgatctcagctgtgtggctgcaactcttcgctgttcattggttcctctcctggaaagtggcttctaaccagcactggatggtgatcattggtaagctttgctcacctccctctctcttgcttcatttggctttatcaaaaagaacagacctagctctgaatttgtttggcttgggaaattatggattctttcaagccactcccacaaggtgggtcctactagaaagggttagcattttaaggggggttgttctatacacctgtgtccttaccccaggctcaggaactgccagggagggaagatgaggtggggagtctgtactgagatggaactgtcagtgctgtgttgtatgtacttgctgttgtaaaagtttgggcatgactttgcatctagcgggtgctgcctgcatctctttgtctgtaagcttgctctgggactcagcctcttaggacctacgatgccagcagctctcattaacagtgaaatgacagaggccaaagatggccaagtgaagacccaagtctcagaaaacccagacttgggacaactgcctgggaactaggatgctagagcagttctgtaatgctttgagacacagcaattttcacattggccattctttcccctcccctaccccttttcttttgagggacttttaatgtttgctgctttaggtggatggagagtccaccagtcccactcaatgctgctctaactctacccacacccacctaattaggggtgctaataaaacatgctgaggttgagataaagacgggacataaggggaaaattcattccatagagctgaaatctggttttcaaggcctctgtggctttcttctgaacttaccaccagccctggctggaatgtagattgtgtttttagtaatgtgtactgtgagctgtcttctgtataatgtattttgtaatgtatttttctcatctaccaaaggatgaaacaaataaaattatttaaatagt

SEQ ID NO: 419 - DNA, 2985 bp, Human
gcgtctttccggcttctcgccaggggctggcttgggggcttctggcccatctcggtccccgtctcctagccccgaggggggagtccgcggcggcccaagcccttgtggggtccatggccgccctcagccggcctgctcccgggaccggggcggggcggggcggggcggcgcagctccggctgttgtttgagcccaggccggcaaggggaacggcccttaagttttaacgcctcatttttcagtcggattttccttcttcccgcttgttcagccaattgtttttaagtttgcgtttaaggagaaactgacaatgagaatggactcgttgacggaggaaaagttggaatgcagactctggtgctgtttgagcgacccctctcccccgggcctggctgcgcgctgctgtgttctggaaaggagcatagtaccgtcgttgcggcaggaatcctatccatcttcttcaccgatatggtttgtggattctgaagacccaaatctgacatcagttctggaacgtctagaagatactaagaacaacaatttgcttcgtcagcaattgaagtggttgatatgtgaactctgcagtttatataaccttcctaagcacctggatgttgagatgctagatcaaccactacccacgggtcagaatgggacaacagaagaagtgacttcagaagaagaggaagaagaagaagagatggctgaagatatagaagacttagatcactatgagatgaaggaagaagagcctattagtgggaaaaagtcagaggatgaaggaattgaaaaagaaaatttggcaatattagagaaaattaggaagactcaaaggcaagaccatttaaatggtgcagtgtctgggtcagtgcaagcttcagatagacttatgaaagagctcagggacatatacagatcacagagttataaaacagggatttattcagtggaactcataaatgacagtttatatgactggcatgttaaactgcagaaggttgaccctgatagtcctttgcacagtgatcttcagatcttaaaagaaaaagaaggcatagaatatattttgcttaacttctcttttaaggataactttccatttgatcctccatttgttcgagtggtgttacctgttctctcaggagggtatgtattgggtggaggagcattatgtatggaacttctcacaaaacagggctggagcagtgcctactcaatagaatcggtcatcatgcaaataaatgccaccttagtcaaaggcaaagccagagtgcagtttggagcaaataagaatcaatataatctagcaagagcccaacaatcctataattccattgtacagatacatgagaaaaatggctggtacacccctccaaaggaagatggctaaatatgttgactgttgtatgtttggactaatgttgctttaaagaaaatctttccaacatgcagacaaaagctttgagtgcccctattacagcagtaccgaagatgttagttaatagatattttagtggataatctgtcatctgacatccagtataagttacagcctttgcattttgctcattttagatatcttggactgagcagtggggcctttactgtatttttcctgataaatacacatactggccactccttatctctttttcttgaaaagtgaactttttaaagcagccaagtcaacatcaggctactgaagttgaggctttagggtaactttcctatattgagcccatgggttacaaggatttgcaatatattgttccatttacagccaatacaggtttaatcgatgttcaatattggtttaggaaatttaaggccttctaaatcataatagctctttcatgtctaaaaccattttatgatattgccaaaatgtgataggaaacctactcattaaattgttaaactttttaatgactatgtgaagatatgaattgtttcctgaagataatactcttaattgagttgtattgtacttcttaggcaaagcagtgtaaaactgtatcaattaaggcttgtgagtagtgatttccactggggcatcagagtcttggctgggctgaatctgctgcttgttggttcagtgtttcttatgaacaagagccacagtacagagcttcaagttatttaaaatactaagtcatcttacgtttccattttattaacgggatgttgcaatcgtttgtaaactaataaacttataaagtgattggcacaaagactccttgagcaaaagctgtgcagttaagtacaaaaagatacttaatttggagactcttacagtaatttttgccatgtcaaaacaatggcttttacattgaaagattaatagaaactctacatatgttaatttttttatagaacctgactcaaatcaaggtactctccattttattgccttacctgaatcagtcctttttggttggtaatagatttttttatacacccacgtttgatttaaaagtaaattctagttcttaagcacttttaacaaatccagaagcacatttttctgcacaaacaagttacaaagttcaaaagtgtttcttgtgcattagctttgagattcagtttttaactttgtaaaccacatctgagagacttgtcatttctacattgtgtgtgtttaatttcttttgattccattttggttaagagagcagtaaatagattttctggtattcttgttcacttgattacatttgtataaagttctgattgccagttgctcagataacaagtgacaaggcagaattctttaaatcagtaaagttccttaagcctaaggctaaatcttgaatacattgttgaattctttaatatcctgatggcaagcagactgatagctgcacatttggcatgctttgtttaatggattttatttttaattgcagatttatttggcaatgtacagtaaattttgtaaacttgcatcaagtttatgaataaagaaccatttaaaaatttaaaaaa

SEQ ID NO: 420 - DNA, 3137 bp, Human
agcaccgtctgggctgtggaagcggagggggtggggacactctggcccggttctcggtggtgcgggagcgggcgggagcagcggccgctctggtcggcggacgtgctgccgagtagtcccggaagcgaagcagcgatggcggagagtccgactgaggaggcggcaacggcgggcgccggggcggcgggccccggggcgagcagcgttgctggtgttgttggcgttagcggcagcggcggcgggttcgggccgcctttcctgccggatgtgtgggcggcggcggcggcagcgggcggggccgggggcccggggagcggcctggctccgctgcccgggctcccgccctcagccgctgcccacggggccgcgctgcttagccactgggaccccacgctcagctccgactgggacggcgagcgcaccgcgccgcagtgtctactccggatcaagcgggatatcatgtccatttataaggagcctcctccaggaatgttcgttgtacctgatactgttgacatgactaagattcatgcattgatcacaggcccatttgacactccttatgaagggggtttcttcctgttcgtgtttcggtgtccgcccgactatcccatccacccacctcgggtcaaactgatgacaacgggcaataacacagtgaggtttaaccccaacttctaccgcaatgggaaagtctgcttgagtattctaggtacatggactggacctgcctggagcccagcccagagcatctcctcagtgctcatctctatccagtccctgatgactgagaacccctatcacaatgagcccggctttgaacaggagagacatccaggagacagcaaaaactataatgaatgtatccggcacgagaccatcagagttgcagtctgtgacatgatggaaggaaagtgtccctgtcctgaacccctacgaggggtgatggagaagtcctttctggagtattacgacttctacgaggtggcctgcaaagatcgcctgcaccttcaaggccaaactatgcaggacccttttggagagaagcggggccactttgactaccagtccctcttgatgcgcctgggactgatacgtcagaaagtgctggagaggctccataatgagaatgcagaaatggactctgatagcagttcatctgggacagagacagaccttcatgggagcctgagggtttagaccctgctcccatctccccttcccccactcaagagtcccagcagaatcccttccccccaccccagggatggagaggcactgtgtatctccctccagactcgaagtcatcctgcaagatggcaagaaccaagcaagctccgatcccagggtgtgggagtgggggcctgttcccggtctgacctccttggcactggagcatctggggcttcgttcatccattcatcccgtatcaggggccaaggtacctttacaggagcacctagagcgagggcctttggcaaaaacaaaacaaccaacacacctctccacagggccagctccttagggataagtggaagatggaaattgcaattccaagagggagtgtgcccaaatgatttatggggatacctggaagggagcttggggtgggggctgtctgtgacacttaagcagtctgggtggttgtctatttgtctgtcttcagtcttgaagcagggcttcccaatgcccttttcctccctgccttccttcccccattatttcccacaggccagcataattttgtttttcctaatttatagtcactgttctagacagaccaaagagaaggaacagtggtggagtctaggctgctgatcagtaagctttacctagcacctgagcacctttctcccctcccctctttcctcacccttttctagatgtaagacagaaagtaaatgtgactgggacttaaccaaggtcttggtaaagcctgcatggcaccgtaagaagctgaaaatactgtttgttcccgcaatcactgatttgaaaagttcccaacacaggcagctgctgtgtatatgggattagagccactacatagaatagtctcttacagattttcataaatactagtcacaataagggtatttttcttgggggtggagtaagggggagactgatgctagtccttgttgtattttgttgggctgtccttgtgtattttcaccccagcctgtagtcctcctcacttcaaccccagggatttttggggagcaagggtagccaatggcagagggggttggggctgggactctggaggctcctccccttctttctcttccttccgcctcccccgtgcccccagctgctcttgtcactgtctctgatgggtatttgcctggctttgttgcttctctatctgtatttagctgcagtgatcctttagctggttggctcagaaaaaaaaaaatgtgctttaggtgccctgtaatcctgggcatcaagggaatccatccttcccctttttgatatgttctccccgtacttccagatttattgttatggctcccagtgggtattggcgattcttgtgatgcagggcctcagtcagtgtccagccatgcataagggagaggatagtgtgtacctgccctgccctctgctatgaaggtctctgccttgtggatcatgggactccccttggaggatctgtgcaaaggggggctgggcacaaaggagaatgtcctatttgggagggcaggaagcaaaggaactggacagggattggtgggcttggggaacggaagtttatcttggatacccttgaagaggctgggtctcttcacatgaagatcgaaaagggaccctgcttccaatttccctcttccattcctcgagctactccagggcttagaagaatgctcttggtctgtgggtccagtgttgtctgtcatccatttaagtgttcccactttcaagtgacaatcctctccttggccctgccatagggcagagcatgtctggcatagcagcctgacttttatgccctaatcttgagttgaggaaatatatgcacaggagtcaaagagatgtctttatatctgactgtatataaatgaagtttttttgttttttttgttttcctttttggtgcaataaagtttgttttggcagaaggagaaaaaaaaaaa

SEQ ID NO: 421 - DNA, 3277 bp, Human
gcgtgcacgctgacgccgcgcagtctcgtcccctgccgccgccgtcgccgctgctgtcgccgccgccgccgccattggagtcgacgcctcctcagtgcgtccgcgtcccgggctcaccgccgctgccgcctcgccaggggcccgcgcgcccagcagccgccgccgccgcccggccggcgcccggggaattggcggcggggcccggggccgcgcgagctagggtgacaggcccggcctctaggggaggcccgagccggcgggcgccccggccccgcgtctagttgttcatgaagcatgtcggccaccagcgtggacacccagagaacaaaaggacaagataataaagtacaaaatggttcgttacatcagaaggatacagttcatgacaatgactttgagccctaccttactggacagtcaaatcagagtaacagttacccctcaatgagcgacccctacctgtccagctattacccgccgtccattggatttccttactccctcaatgaggctccgtggtctactgcaggggaccctccgattccatacctcaccacctacggacagctcagtaacggagaccatcattttatgcacgatgctgtttttgggcagcctgggggcctggggaacaacatctatcagcacaggttcaattttttccctgaaaaccctgcgttctcagcatgggggacaagtgggtctcaaggtcagcagacccagagctccgcgtatgggagcagctacacctaccccccgagctccctgggtggcacggtggttgatgggcagccaggctttcacagcgacaccctcagcaaggcccccgggatgaacagcctggagcagggcatggttggcctgaagattggggacgtcagctcctccgccgtcaagacggtgggctctgtcgtcagcagcgtggcactgactggtgtcctttctggcaacggtgggacaaatgtgaacatgccagtttcaaagccgacctcgtgggctgccattgccagcaagcctgcaaaaccacagcctaaaatgaaaacaaagagcgggcctgtcatggggggtgggctgccccctccacccataaagcataacatggacattggcacctgggataacaaggggcctgtgccgaaggccccagtcccccagcaggcaccctctccacaggctgccccacagccccagcaggtggctcagcctctcccagcacagcccccagctttggctcaaccgcagtatcagagccctcagcagccaccccagacccgctgggttgccccacgcaacagaaacgcggcgtttgggcagagcggaggggctggcagcgatagcaactctcctggaaacgtccagcctaattctgcccccagcgtcgaatcccaccccgtccttgaaaaactgaaggctgctcacagctacaacccgaaagagtttgagtggaatctgaaaagcgggcgtgtgttcatcatcaagagctactctgaggacgacatccaccgctccattaagtactccatctggtgtagcacagagcacggcaacaagcgcctggacagcgccttccgctgcatgagcagcaaggggcccgtctacctgctcttcagcgtcaatgggagtgggcatttttgtggggtggccgagatgaagtcccccgtggactacggcaccagtgccggggtctggtctcaggacaagtggaaggggaagtttgatgtccagtggatttttgttaaggatgtacccaataaccagctccggcacatcaggctggagaataacgacaacaaaccggtcacaaactcccgggacacccaggaggtgcccttagaaaaagccaagcaagtgctgaaaattatcagttcctacaagcacacaacctccatcttcgacgactttgctcactacgagaagcgccaggaggaggaggaggtggtgcgcaaggaacggcagagtcgaaacaaacaatgagggcgaaccagtttcttacatgttctaacgtttgactttgaaaacagtttaaaacacgtgtgcttggtcagctccagtgtgtcgtcccgtgcgggggttgagtgttgcatctttgcctttcttgtcgttgatttttgcccagatggatctgcatttatttgtactttttctatgtattataatcctgtagaagtcactaataaaggagtattttttttgtcagcttatcaatcagactgatctaatgtgaaatgtaagtatccttaaaaacaaagcatctattttggcagaaattgtgttcttaaattcagtcatttgatattctgtgagacttcatatttctcatccctttattgctttttagcaaacataagaaaccatgagtcattttgtcatttagagtattctgataaaatctcttgaaaatactgaaatcaaaaggttaatgattttttgttcattctgatttgtcattttattatctgttatcggtctaaagtgctaatttacccatttgatttttctgctagacagataacttttaatttttcaaatttggcagacactttttttttttttttgaaaatctttccttccagatctgttgcccactgaacagccacccgtccctcactgtcctggtgtccgattgggctggatggtgttggggcatgatgtgtggaggaactggaaggtgctttaggtctggttcagggtcgggcattctttgttgtttgcacatctttttaaattttacaccttttcttaagaattctaatgccgtcttaagtttttataccaataatgctgagctttaagtgtaggatctggtagtacagacagtgtgatggatgatgctgctggttgtaaatttcatcgtgtgtgtctaattttttttcctgttgaatgggtaaaaacaaaacaaaactttttttagaagatgaatttgctgtcatgttttgtggaatgagggaccgttgagctcactaccacctggagtttgagttgaagcatgaaaatggtgcccatgcctgacgctccagcgcctggatctgcacgtgcccttgtagaggatccttaccgtcctagagagcagacgctttctgaaaactacttgctccaaaagaccctctgagttaacgtttcagctgtatcattagacttgtatttagagcgtgtcacttcctctgaactgttactgcctgaatggagtcctggacgacattgggtttttcctctaggagaatacaagccttaataaacaatactatttagcaaaaaaaaaaaaaaaaaaaaaaaaaaa

SEQ ID NO: 422 - DNA, 5653 bp, Human
gacaaagagaactaatgctttgtgctgattcatatttgaatcgaggcattgggaaccctgtatgccttgtttgtggaaagaaccagtgacaccatcactgagcttcctaaaagttcgaagaagttagaggactatacactttcttttgaacttttataataaatatttgctctggtttttggaacccagggctgttagaggggtgagtgacaagtcttacaagtggccttattccaactccagaaattgcccaacggaactttgagattatatgcaatcgaaagtgacaggaaacatgccaactcaatccctcttaatgtacatggatgggccagaagtgattggcagctctcttggcagtccgatggagatggaggatgccttgtcaatgaaagggaccgctgttgttccattccgagctacacaagaaaaaaatgtcatccaaatcgaggggtatatgcccttggattgcatgttctgcagccagaccttcacacattcagaagaccttaataaacatgtcttaatgcaacaccggcctaccctctgtgaaccagcagttcttcgggttgaagcagagtatctcagtccgcttgataaaagtcaagtgcgaacagaacctcccaaggaaaagaattgcaaggaaaatgaatttagctgtgaggtatgtgggcagacatttagagtcgcttttgatgttgagatccacatgagaacacacaaagattctttcacttacgggtgtaacatgtgcggaagaagattcaaggagccttggtttcttaaaaatcacatgcggacacataatggcaaatcgggggccagaagcaaactgcagcaaggcttggagagtagtccagcaacgatcaacgaggtcgtccaggtgcacgcggccgagagcatctcctctccttacaaaatctgcatggtttgtggcttcctatttccaaataaagaaagtctaattgagcaccgcaaggtgcacaccaaaaaaactgctttcggtaccagcagcgcgcagacagactctccacaaggaggaatgccgtcctcgagggaggacttcctgcagttgttcaacttgagaccaaaatctcaccctgaaacggggaagaagcctgtcagatgcatccctcagctcgatccgttcaccaccttccaggcttggcagctggctaccaaaggaaaagttgccatttgccaagaagtgaaggaatcggggcaagaagggagcaccgacaacgacgattcgagttccgagaaggagcttggagaaacaaataagggcagttgtgcaggcctctcgcaagagaaagagaagtgcaaacactcccacggcgaagcgccctccgtggacgcggatcccaagttacccagtagcaaggagaagcccactcactgctccgagtgcggcaaagctttcagaacctaccaccagctggtcttgcactccagggtccacaagaaggaccggagggccggcgcggagtcgcccaccatgtctgtggacgggaggcagccggggacgtgttctcctgacctcgccgcccctctggatgaaaatggagccgtggatcgaggggaaggtggttctgaagacggatctgaggatgggcttcccgaaggaatccatctggataaaaatgatgatggaggaaaaataaaacatcttacatcttcaagagagtgtagttattgtggaaagtttttccgttcaaattattacctcaatattcatctcagaacgcatacaggtgaaaaaccatacaaatgtgaattttgtgaatatgctgcagcccagaagacatctctgaggtatcacttggagagacatcacaaggaaaaacaaaccgatgttgctgctgaagtcaagaacgatggtaaaaatcaggacactgaagatgcactattaaccgctgacagtgcgcaaaccaaaaatttgaaaagattttttgatggtgccaaagatgttacaggcagtccacctgcaaagcagcttaaggagatgccttctgtttttcagaatgttctgggcagcgctgtcctctcaccagcacacaaagatactcaggatttccataaaaatgcagctgatgacagtgctgataaagtgaataaaaaccctacccctgcttacctggacctgttaaaaaagagatcagcagttgaaactcaggcaaataacctcatctgtagaaccaaggcggatgttactcctcctccggatggcagtaccacccataaccttgaagttagccccaaagagaagcaaacggagaccgcagctgactgcagatacaggccaagtgtggattgtcacgaaaaacctttaaatttatccgtgggggctcttcacaattgcccggcaatttctttgagtaaaagtttgattccaagtatcacctgtccattttgtaccttcaagacattttatccagaagttttaatgatgcaccagagactggagcataaatacaatcctgacgttcataaaaactgtcgaaacaagtccttgcttagaagtcgacgtaccggatgcccgccagcgttgctgggaaaagatgtgcctcccctctctagtttctgtaaacccaagcccaagtctgctttcccggcgcagtccaaatccctgccatctgcgaaggggaagcagagccctcctgggccaggcaaggcccctctgacttcagggatagactctagcactttagccccaagtaacctgaagtcccacagaccacagcagaatgtgggggtccaaggggccgccaccaggcaacagcaatctgagatgtttcctaaaaccagtgtttcccctgcaccggataagacaaaaagacccgagacaaaattgaaacctcttccagtagctccttctcagcccaccctcggcagcagtaacatcaatggttccatcgactaccccgccaagaacgacagcccgtgggcacctccgggaagagactatttctgtaatcggagtgccagcaatactgcagcagaatttggtgagccccttccaaaaagactgaagtccagcgtggttgcccttgacgttgaccagcccggggccaattacagaagaggctatgaccttcccaagtaccatatggtcagaggcatcacatcactgttaccgcaggactgtgtgtatccgtcgcaggcgctgcctcccaaaccaaggttcctgagctccagcgaggtcgattctccaaatgtgctgactgttcagaagccctatggtggctccgggccactttacacttgtgtgcctgctggtagtccagcatccagctcgacgttagaaggaaaaaggcctgtgtcatatcaacacttatctaacagcatggcacaaaagagaaactatgagaattttattgggaatgcacattatcgaccaaatgacaaaaaaacttgattcactaattagggggaaaaaaggtcttggtggatgtcagtgcttactccccatgaaattaaattttacttcatcctttgagaagcgaatggtgaaagctactgaaataagctgtgattgtactgtacataaaacatatgaggaatctgcaaggaacactacagttgtgtaaagttgttctgttaacttttgtaccaaatagcaatacaaactagttggaacagttggaacttacatacatggggactggaaatctctattttgtccctgaataatatttttcttagaattgaccaaataagaagtggaatttttgcatacttgagcgctgctgaaaagaaatcatttgggttgggtggggcgggatgggggaaaagtatataatgcttgcacctcaggtaaaaatctgtaaatatctaagttgtaaacctgcttgttcaaatactgtgtgtattccttttctctaatgcagctcatcacttggagcagtttctgctattgtgctctttcatttaaaatgtatgtttttttttttttaaactgtcaatgattttgtattatgttgaatccacccaaatctattgttgtcttaaaattgttaatggaagtattgaccctctatgatatgtgctgcagatatcgaggtcagccattcggaagctggcagcattttatcgcaactttgagcatctcagatggggaaggcaccttcttcctcgcctctccagattgtcctggaacctccaggatccttgactgagggcgttgggatggcttgtaggatttttaagagagtgtgtctacagacaagcattttctctgtagagcagccacacgttgtataaacataaactgtatgtgcagttatttaaatttgtttctgtcaaattaatcatttttgttggacgattcagtggcgggggggttttgcctaaattagtatataaaaacaaaaatgctaaattatatctgtgaattgcaggtattggggaacagttttaagggaaattttggggggaacattttaggtttgtatttggtagtcttaatgtatctggcatttgggtgaactgtggacatactagagttgattatagacacattgattttgaataaggaactgctggccgagcccgctgggagtctagaaagagaaaatctgtttctagacctcagttattttcccatttttggttgttttgaagcagtaacatttttctcagtgcacatgcaatttgggttttagagaagatggccaccagctggcttcctagatattttaaacttttgttctttaatatgctgtccatggctgagtttattagtacatgggcttagtgaccacaaaatattttattaagaaactgtttcaaaaataaatttgcactgttcatttttctggcctcgctgttctccatagagcaagggtaatcctagaaaaaattttttttttttaaattatgcaacgtaagatgtcctccttgatagaagtcttagctcctgtgttacaagggagaactcatttgagatcagtctgttggcattgcaatgaagtgctttgtatcaggaaagtgtacactattgaccttttttcctgttcacaagctgagccatatgtacataatctagattttgttttcatagttttgcacttttatagcctatttttgaagattaacacatttgcaagatgattgactcaatctttgcctaatccaatgagtgttacagagagcttgctgtgactagaaccataaatcttaaagggggtatgtgataatagagggctggaatttaaacctgtatttaaaaaaaagaatcaccaaatctatttgaaaacaagtcgatttgtattatgctggaattttttgggctttcagatttctctttttaaccacatttctgaatgtataaaaataccaattattttcctacagccctttgtacttcaaaatatgtttttgtgtccatcagtattaactattggtatactactggttttatatttttttttctttgagacaacagtacatataatagaggtacaattcgttggatttttgtttatgtatttatttcattccagtttgatttattttaattgttgatacttaagttgtcgaacagtagacattacttgttttatttatgatatatttcagcttaaagttatgttattatatgtggaagtgtaaatatagatttggtgttttgcaaaaaaaaaaaaaaaaaaaa

SEQ ID NO: 423 - DNA, 1449 bp, Human
cttctccgtgcagggcctcagctgggtcagccgagtgagtggggctgggcaggctggacaggctgggctcctgctccctggggagccacgctggggtgggcagtgggcaggcagcaggagggcctggtgccagggcagagccttcaggacaggcacaggctggggtctgtgtgcagagcctcggggtgggtctacatcccctttcagcagccccatcacctccgacgaggaatacctgagccccccagaggagttcccagagcctggggagacctggccgcgaacccccaccatgaagcccagtcccagccagaaccgccgttcttctgacactggctccaaggcaccccccaccttcaaggtctcacttatggaccagtcagtaagagaaggccaagatgtcatcatgagcatccgcgtgcagggggagcccaagcctgtggtctcctggctgagaaaccgccagcccgtgcgcccagaccagcggcgctttgcggaggaggctgagggtgggctgtgccggctgcggatcctggctgcagagcgtggcgatgctggtttctacacttgcaaagcggtcaatgagtatggtgctcggcagtgcgaggcccgcttggaggtccgaggcgagtgagctcagggggccacctgtgctccccccgctaccctccgagccgcgcccctgtctcaggcacctctcggacctcgctgtgtttcactgcctcctgcccacagacccaggcctgccggcccggacccgtcccagcctcccctccccaccccatgcagcccccagggggatagcccatgggcccctgtggaccctccctccccaagtggacacatggctgtgcaggccaggaggcccacagatggactgagtgctgggaaggggcggctgcgaggggtatcaaccccccgagtctctccctgaaggggagcaccgggcgagtgcatgtgctactgctgctacaggcctgtctatctgtttgtctgtctgtgtgtctgtgacagtcagggaaggatgcctcggagctgaggtggggtgagacagagtgggagagattacggcatggcatggaggggcccaaggagcaggggctgttgacaaaggccttaccaggaagggttaggacactgaccattctagaaatgggtttcgaatggcacaacactttctatttcacaaaagaccaaaagccagaggccccaggctctgtgctgatgaacagcctggctgagccctggccctggcaggtttagggcccatttggggccccctccttctctgtcagggctggggtgctctgtctgggaatgagggagttaaccaagtttggtgcaggagcaggggcagggggccactgtagtgagcgtggagaaatttggaaacacctatttcttaactcaaataaagtccagtttgtacctaaaaaaaaaaaaaaaaaa

SEQ ID NO: 424 - DNA, 2293 bp, Human
agaggaggctagcgttccttgctgcctcgccccgcggcctctaggagacaggggccacggggagagcacagccacccggcgcgaagagccctctgtaccccgcttcctcttgaggccctcggaccgtccaggaaatgtctgggagcccgcctgcggagggcatagcgccgaccctcgctccccgcccaggacccgaatgaacctggagagcggatgccagcagtggccgaggcgctaggacaggaaggaccgccagacctctcaagatcagccttcctcgccaccgttctcacctctttgtccgctgccttctcctcaatgcctagcagcgcgtacaggtccatctgtaagagctccttggtcactgccatggttccggcctgacggattcgtactacaactcccaagagtctaagcgcgcgtgaggactgcaggctccgagcggcgcctagccctctgggaattgtgttctgggtcaggcttgactgactctgagggaggccggcagtcgtgaatgaactacgactcccagcagcccccgttgccgccgctgccgtacgctggctgcaggagagcgtccggattccctgctctaggtcgcggcgggacagtgccagtgggcgtgtggggcggggcagggcagggaagggaagggcggagctggggtgagggtccaaggggcccaggacttggccggcgtgatctcagctctgcagaccctgcggtgctgggagccaccatggagagtaggtgctacggctgcgctgtcaagttcaccctcttcaagaaggagtacggctgtaagaattgtggcagggccttctgttcaggctgcctaagcttcagtgcagcagtgcctcggactgggaacacccaacagaaagtctgcaagcaatgccatgaggtcctgaccagagggtcttctgccaatgcctccaagtggtcaccacctcagaactataagaagcgtgtggcagccttggaagccaagcaaaagcccagcacttcccagagccagggactgacacgacaagaccagatgattgctgagcgcctagcacgactccgccaggagaacaagcccaagttagtcccctcacaggcagagatagaggcacggctggctgccctaaaggatgaacgtcagggttccatcccttccacccaggaaatggaggcacgacttgcagcgttgcagggcagagttctaccttctcaaaccccccagccggcacatcacacaccggacaccaggacccaagcccagcagacacaggatctgctaacgcagctggcagctgaggtggctatcgatgaaagctggaaaggaggaggcccagctgcctctctccagaatgatctcaaccagggtggcccagggagcactaattccaagaggcaggccaactggtccttggaggaggagaagagcagactgctggctgaggcagcacttgagttgcgggaggagaacacgaggcaggaacggattctggccctggccaagcgactagccatgctgcggggacaggaccccgagagagtgaccctccaggactatcgcctcccagacagtgatgacgacgaggatgaggagacagccatccaaagagtcctgcagcagctcactgaagaagcttccctggatgaggcaagtggctttaacatccctgcagagcaggcttctcgaccctggacgcaaccccgcggggcagagcctgaggcccaggatgtggaccccaggcctgaggctgaggaagaggagctcccctggtgctgcatctgcaatgaggatgccaccctacgctgcgctggctgcgatggggacctcttctgtgcccgctgcttccgagagggccatgatgcctttgagcttaaagagcaccagacatctgcctactctcctccacgtgcaggccaagagcactgaagacaccctggtcctcccggaagggcagtcccacaggcagcggcacccatttctgggcccagccacaggacgtccgatgggagagcttgtctggctctactgatgatggataggccccttcctgagccttggtgtccctggaatgaggaaagattctccattcgagagaatgactgggagggaagaagtcggggccctcctattagaagcccagactggaagtgagaggcatgatggggagagaccagactgaatctacgggtgagccctgtaacctggctctagggcacaggcccctcccctggcacttagtgggtctaataaagtatgttgattcattgggaaaaaaaaaaaaaaaaaaaa

SEQ ID NO: 425 - DNA, 2172 bp, Human
aatcccttcaaccttctgcgcgcttccgccttcatgctagcaacgcccgcagtgacgcgcaggccccgccccctcccgcgcgcctcccggaagtggccggtccagagctgtggggtggcctccgcgcggtctctggcggagtcggggaatcggatcaaggcgagaggatccggcagggaaggagcttcggggccgggggttgggccgcacatttacgtgcgcgaagcggagtggaccgggagctggtgacgatggcggggccgcagcccctggcgctgcaactggaacagttgttgaacccgcgaccaagcgaggcggaccctgaagcggaccccgaggaagccactgctgccagggtgattgacaggtttgatgaaggggaagatggggaaggtgatttcctagtagtgggtagcattagaaaactggcatcagcctccctcttggacacggacaaaaggtattgcggcaaaaccacctctagaaaagcatggaatgaagaccattgggagcagactctgccaggatcgtctgatgaggaaatatctgatgaggaagggtctggagatgaagattcagagggactgggtctggaggaatatgatgaggacgacctgggtgctgctgaggaacaggagtgtggtgatcacagggagagcaagaagagcagaagccactctgcaaaaacaccgggcttcagtgtccagagtatcagtgactttgagaaatttaccaagggaatggatgaccttgggagcagtgaggaggaggaagacgaagagagtggcatggaagaaggggatgacgcggaagactcccaaggcgagagtgaggaagacagggctggagatagaaacagtgaggatgatggtgtggtgatgaccttctctagtgtcaaagtttctgaggaagtggagaaaggaagagccgtgaagaaccagatagcactgtgggaccagctcttggaaggaaggatcaaactacaaaaagctctgttgaccaccaaccagcttcctcaaccagatgttttcccattgttcaaggacaaaggtggcccagaattttccagtgccctgaaaaatagtcacaaggcacttaaagcattgttgaggtcattggtaggtcttcaggaagagttgcttttccagtacccagacactagatatctagtagatgggacaaagcccaatgcgggaagtgaggagatttctagtgaagatgatgagctggtagaagagaagaagcagcaacgaagaagggtccctgcaaagaggaagctggagatggaggactatcccagcttcatggcaaagcgctttgccgactttacagtctacaggaaccgcacacttcagaaatggcacgataagaccaaactggcttctggaaaactggggaagggttttggtgcctttgaacgctcaatcttgactcagatcgaccatattctgatggacaaagagagattacttcgaaggacacagaccaagcgctctgtctatcgagttcttggcaaacctgagccagcagctcagcctgtcccagagagtttgccaggggaaccggagatccttcctcaagcccctgctaatgctcatctgaaggacttggatgaagaaatctttgatgatgatgacttttaccaccagctccttcgagaactcatagaacggaagaccagctccttggatcccaacgatcaggtggccatgggaaggcagtggcttgcaatccagaagttacgaagcaaaatccacaaaaaagtagataggaaagccagcaaaggcaggaaacttcggtttcatgtccttagcaagctactgagtttcatggcacctattgaccatactacaatgaatgatgatgccaggacagaactgtaccgctctctttttggccagctccaccctcccgacgaaggccacggggattgacatcgcccacctccgacacccagtgggcgccttggctggtgcggctgctggtccagatggaggaaaccagtgactttatggggctgagctagtagggaagcccctggaaagatgctgcgttccgaacctgtgcctaatacacgcaagggcgctgtcccgcccaaccccgcctttaaacgccacaaataaagagcattgttaccgccaaaaaaaaaaaaaaaaaaaaaaaaaaaaaaaa

SEQ ID NO: 426 - DNA, 6533 bp, Human
gggaatctttttcgggctcccgggggcggagggaagggagcgcgcgtgcgcgcgcccggccggccgtcgccgcggtgaccgtcctcggagtccgtcggctcgcgccccgcccccgtcgccccctcccctgtcgcgcgctggggctgtttctcgctccttccgagttaccgccgccgtcgccgccgctcctcctctcccggtcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaaacagttgatattcataaagagaaagttgcaagaagagaaattggtattttgactaccaataaaaacacttcaaggacacataagattattgctccagccaaccttgaacgaccagttcgttatattagaaaacctattgactatacaattctagatgatattggacatggagtaaaggtgagtacccagaacatgaagatgggtgggctgccgcgtacaacacctccaactcagaagccccctagtccccctatgtcagggaaagggacacttgggcggcactccccctatcgcacactggagccagtgcgtcctccagtggtaccaaatgattacgtacctagcccaacccgtaatatggctccctcgcagcagagccctgtgaggacagcttctgtgaatcaaagaaatcgaacttacagcagcagtgggagtagtggagggagccacccaagtagtcggagcagcagtcgagagaacagtggaagtggtagtgtgggggttcctattgctgttcctactccatctcctcccagtgtctttccaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtatctcttgctcctcctcctccctccatcctacaggtaactcctcagttacctttaatgggatttgtggccagagtccaagaaaatatttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgatggttggtatgagggagttatgaatggagtgactgggctttttcctgggaattacgttgagtctatcatgcattattctgagtaaagctcagcagggctgtgcttgcctcacaggaatagtcaggtcttcccagattatctgaaggccctggggattccactccagtaaagtagaatgaaggatacaaatgataaaaattacacttttttttttggtttattccccagtattaaaaacaaagcaagctgagtctgaacaaatggatctttctgccatcatttgtacaatgctgagctgtctggattgaaataaaatgaccatttttatgtatgtcaaaggtataacagcataactgtgtagccaaaacaaaatcagattaagactgattcagaaaaatctgggatctttctcaggaatactgtatacccttgggatttctcctcctgcagaatctgtggcattggatgttcttcattgcctgtgctaaggggttaacctcatggcccagtgggtaccctagccccttcttttcttccacttgtatgaagaggagggaaccaacatttaaataccacacttaaccatttttacaattatttcagatggcttttttcctctgtgacactgtaaattctgcattctctcagcacttgagtgcaccaaacgagtgaatgctgaactcacttgcatcccttcatgtttctgtttgtggattataaggatgatgaaatgtgaaagtctcccaacactctgagggtggtgaacgattgccacccgtttgattttaatgtgctgctgcatgagactgcattgttgctaatggccagtgtacccagatgtgaagtgtggtaggctggttcatatgtggaggtgggtgtgtgaagctagacacgaaggtccctaaggttctgaagagacttgaactgtggaaatgctcttagcaggcatcccgaacccctgcttcggtgctgttttgaggagtaggatcttggagttcagaccaactatgactatcatttccttcactatctagaaaaacgctattctactttggaagagaatagtagttattttcaagtctcctgacagtcactgggagtacaaggtttgctaatgtgctctctggacgttattaatggccagtattagttgctgctgtattactgactcgcttagctgtagaaagggtaatactctcctgattttgtatgattggactcttaagtagctgctgttagtcagaattaaaacccatctcagactaagaatataatgaataagattaataggccaaaatatgtatctaatcacattgataaaaattaatataactgacacaataaaacacatttcccccatctgtacaataaatacagcttcaaattcagtggagtctgtagggcagataactttaatcatcactactgtagtcagtataagaaatgctgaaaaaaatccaggagggcttgtctctttgtgggtggtcactgtgatgttgggccagctcctgttcaggtccagagctgctaacgtgggttctactcagtcccagtgacttggccagaatagagctttgccaggtaactgccctgtgctaggtgaaaggggaaaagcagtagctggatatatttcaaatgaggttttgaacaagttcagaaagtggaacttgattgaaaagtgaacaagtgtagtagtgtgtgagaaaattcagatggtgtcggatgcagaagttaatattccacttaatgttatctgagcattaaaaatcatcagcatttaactgagaccccactatagagtttccttatcaagactttttggttttaaagttgtttttaatgcattgcaagttacaatagctattttgcttttagatttttcccagcactttgtatttattagctttcattaacttgcctccagtatacattccacttcgtgcttttcttaggtcatttctacatcccttattccttgttttcctgcagtgtaatggccctgaatgtcctctgagccttcagctccattatggacccaaactagactatacttggataagttaagctcttcttcgtgtactggtctataattagaaaaactgttttaaattagatgttcccattatttatttaaacagctttttgctgagaaagcttagtggattaatgaggcagagggtgttttgaaatccaataaatagttcccacaggctgggtgtggtggcttatgcctgtaatcccagcactttcggaggccgaggtgggtggatcatgaggtcaataaattgagaccatcctggccaacatggtgaaaccccatctctactaaaaacacaaaaattagctgggcgtggtggcgcacacctgtagtcccagctacttgggaggctgaggcaggagaatcactggaacctgggaggcagaggttgcagtgagccgagattgtgccactgcactccagcctggtgacagagcgagactccatcaaaaaaaaaaaaaaaaagttcccacagctcaccactacagaagcagggaagacaactatgcagaaaacagagttagtggcggtcagcaggaatgcagctggtcttttggacccctacgggatgggggcagtgcagaagacactggtgaagtcctttatactgaagacctgtggttgggagcaggggtagtccatgggtctgctgattttttttccctatttagtactaatgtgtgtgtgatctttgttttacaaacagtaccttttgggttttctgcatattttataatttttgtacagttttgaattctatagattgtcttggaaggatactgtgtgatgggtcaggcacacagtaattggagacttttaatgtatgtaatatttcatagattgcatgctattaatcatctgtgagggtagtattttttgttttattgtaagtttccctctttttttataaattaaaagatggttggtattaggaatttcaaatgaatgcagaaaatcttacatgctgtgtactattaatattataacagacgatccaagtccaaaatctgaccaataaagcaaccattttatcaagatagagggattctaatgggagaggggattcttccctcctgaagtttgtgtgtccagtccccttaaaaaaaatgaatagttgtcttttcttgtcatattaatactcgaaagtccatggtggtattaatgaaagtacactttattgttgcctttgaacttacggccaaggcaataaatcagaaacaaaaatagtgccaatgtgtcaaaatcgacatctgagagattcagcctcccatttggaataaatatgaatcttctaagctatcttgtttaatattttccatcatttagctacttcctatctccctcagaggcgcctgctgttcccattttagagttgacagtggcctgctaattttgctatgttcctaaaagttactgggtgtgagacattttcatcccctcctttttcctactgctggtgtttattatccagctagacaatattttatgcatatttaccgtgatgtctggaccgtacctgtgctccttggcagtttatgttgaagataactaaagatttttctctttgggaggcatcaaaatgatggtagtttgcttttatctttttatgttcattttcttttagtaggtgacctttctgcattaagaactgtttttatcttttactaccttttcttttctcctttgtggagacagcatgacatgtcctgaaggtcacctttgcctttgaaaaaggtttgatggaggaattcacaggtgactgacaagtctttgaaaagaatgggatctgctcacttctggtctttttggccgggaactcctgattggtgttaaggtggtaatttcccccatataagatttagaatcactgagtttgagctagatgaaatttttaaaatttctggttgtctcattagactgatgaggtgagttttcttcttcatatgaacagctagttaataacagcagagttctcactcagtgctcagtacttaattttccactgcaccacaactgtcttaactaaatgtgctgtatttttctttaaaagttaagagttctatttggtgttttcaggaatatacgtgaaaagacatgccatgttttggtaaataccatcagagttgtgtaaaggcgtgtactaagtgcaatcttaatttgtggaaataatcttcatttacccctcctaaaactacactcagtataaacactttcccataaggtgtgtgcagtaaaaatgttatattactccaacactggcaggagcacagcacagcagccttattggagagagccttataaaagtgattaaatggaggcattgagctcattacctttaagtttactttgtgctgacctttgttcctgttttgagaatctcatataattattaaaaaaaaaaaacaattaaaacgaaacggcggggcctagctgtgtataaatgatccttgctgaatatcttaaggttttttgtaagaaaaaagaaaaaccaacaaaaaaagcttattttcacattaaaatgaaacctcttttgcaacttaagaattctatggaaaagcagtttttatcatattttgtgtccatgcaccatttttcttaaaatggcttacaaaaaagaatgtaaacaatttgtgatctggccagttgtacttttagctcccagagggagagttggtggtattatgagttgagtaaaaaccatccaggggaacttgagggagcagtctgttgccagtaatgttccttgtgtgccattaaaccacctccagatgagtggaggaacatcactttttaattttttaattgtatttggaattgttgccgtgtactaagaacttgacctaaataaaatcccacaaagtatattcaaaaaaaaa

SEQ ID NO: 427 - DNA, 1617 bp, Human
ttcccgcgactccgctctcaccgctacactaccacacaaacggcctccttcccccacccccgggggcccatcccggtggcgggctccggagctcgggactgctaatttcagcgaaacgattaaaagacgcccctacagctgacggcactttctctcctccggcagggaaggacgtccagcgtagcgtcgcccgcgcttccccgccggcgcagagcaggcctcacagaatcgcacgccgctggcacgcacgccgccccgcccccacggcccagcgccagccgcgccccgcgctcgcacgcatcccggcctcactgcccctcgactcctgttccgttggaggggcctgaggcgagcctgagcgcgctgttggccggagggaagccggaggagaccgggtcgactgggcagagcggcagagggtcgaggagcctgctctgcacgcccagggagtagaagtgggcagggagcagggtcacgtgagggagcgcgccgcgactgagcttgggtccgactggagctcaggctcgcgacccagactggtgggccaggcctccaagccggccttacacccaatccaaggaggacagaccggacacagagggacggagcgagcaaggagacatggcttcatcattcctgcccgcgggggccatcaccggcgacagcggtggagagctgagctcaggggacgactccggggaggtggagttcccccatagccctgagatcgaggagaccagttgcctggccgagctgtttgagaaggctgccgcgcacctgcaaggcctgattcaggtggccagcagggagcagctcttgtacctgtatgccaggtacaaacaggtcaaagttggaaattgtaatactcctaaaccaagcttctttgattttgaaggaaagcaaaaatgggaagcttggaaagcacttggtgattcaagccccagccaagcaatgcaggaatatatcgcagtagttaaaaaactagatccaggttggaatcctcagataccagagaagaaaggaaaagaagcaaatacaggttttggtgggccagttattagttctctatatcatgaagaaaccatcagggaagaagacaaaaatatatttgattactgcagggaaaacaacattgaccatataaccaaagccatcaaatcgaaaaatgtggatgtgaatgtgaaagatgaagagggtagggctctacttcactgggcctgtgatcgaggacataaggaactagtcacagtgttgctgcaacatagagctgacattaactgtcaggacaatgaaggccaaacagctctacattatgcctctgcctgtgagtttctggatattgtagagctgctgctccagtctggtgctgaccccactctccgagaccaggatggctgcctgccagaggaggtgacaggctgcaaaacagtttctttggtgctgcagcggcacacaactggcaaggcttaatcaaaagactggaaaactgcagtctgtaatagcataaggcttccattatgaaagaaaactacaaaaataatacttcttttccacccgtctttggtatgtattggctaataaaatcagttctgtggaactgggattttgaagtctcaa

SEQ ID NO: 428 - DNA, 1250 bp, Human
gcttctgccctcaaccaaaatggcgctagctcggaagctgccgaggtgctaggagttgccgaagcaagtccggaagctaccgagcgagtccggaagttgccgaaagggagcagcggggaaggaggatggcggatatcatcgcaagactccgggaggacgggatccaaaaacgtgtgatacaggaaggccgaggagagctcccggactttcaagatgggaccaaggccacgttccactaccggacgctgcacagtgacgacgagggcaccgtgctggacgacagccgggctcgtggcaagcccatggagctcatcattggcaagaagttcaagctgcctgtgtgggagaccatcgtgtgcaccatgcgagaaggggagattgcccagttcctctgtgacatcaagcatgtggtcctgtacccgctggtggccaagagtctccgcaacatcgcggtgggcaaggaccccctggagggccagcggcactgctgcggtgttgcacagatgcgtgaacacagctccctgggccatgctgacctggacgccctgcagcagaacccccagcccctcatcttccacatggagatgctgaaggtggagagccctggcacgtaccagcaggacccatgggccatgacagacgaagagaaggcaaaggcagtgccacttatccaccaggagggcaaccggttgtaccgcgaggggcatgtgaaggaggctgctgccaagtactacgatgccattgcctgcctcaagaacctgcagatgaaggaacagcctgggtcccctgaatggatccagctggaccagcagatcacgccgctgctgctcaactactgccagtgcaagctggtggtcgaggagtactacgaggtgctggaccactgctcttccatcctcaacaagtacgacgacaacgtcaaggcctacttcaagcggggcaaggcccacgcggccgtgtggaatgcccaggaggcccaggctgactttgccaaagtgctggagctggacccagccctggcgcctgtggtgagccgagagctgcaggccctggaggcacggatccggcagaaggacgaagaggacaaagcccggttccgggggatcttctcccattgacaggagcacttggccctgccttacctgccaagcccactgctgcagctgccagcccccctgcccgtgctgcgtcatgcttctgtgtatataaaggcctttatttatctctctctgaaaaaaaaaaaaaaaaaa

SEQ ID NO: 429 - DNA, 8300 bp, Human
agaggctgcggtgagtccgccagccccagctgctcctcctcaagcccccaaggcccttcggcgggcccctgctgaaagaccggcatgccctattctgtgggcttccgcgaagccgatgctgctaccagctttctgagagcagcaagatcaggtaacttggacaaagctttggatcacctgcggaatggggtagatattaacacctgtaaccagaatgggttgaatggcttgcatctggcttctaaggaaggccatgtgaaaatggtggttgaacttctgcacaaagaaatcattctagaaacgacaaccaagaaggggaacacggccctgcacatcgctgctctagccgggcaggatgaggtggtccgggagcttgtcaactatggagccaacgtcaacgcccagtcacagaaaggttttacacccctgtacatggcagcacaagagaaccacttggaagtggttaagtttttactggaaaatggagctaaccagaatgtagccacagaagacggcttcacgcctctggcggtagccctgcagcagggccatgagaacgtcgtcgcgcacctcatcaactacggcaccaaggggaaggtgcgcctcccggccctgcacatcgcggcccgcaacgacgacacgcgcacggctgcggtgctgctgcagaacgaccccaacccggacgtgctttccaagacgggattcacgcccctgcacattgcggctcactacgagaacctcaacgtggcccagttgctcctcaacagaggagccagcgtcaatttcacaccacagaacggcatcacgccactgcacatcgcctcccgcaggggcaacgtgatcatggtgcggctgctgctggatcggggagcccagatagaaaccaagaccaaggacgaattgacacctctccactgtgcagctcgaaatgggcacgtgcgaatctcagagatcctgctggaccacggggcaccaatccaagccaaaaccaagaacggcctgtccccaattcacatggcggctcagggagaccacctcgactgtgtccggctcctgttgcaatacgacgcagagatagacgacatcaccctggaccacctgaccccactccacgtggctgcccactgtggacaccacagggtggctaaggtccttctggataaaggggccaaacccaactccagagccctgaatggctttacccccttacacatcgcctgcaaaaagaaccacgtccgtgtcatggagctgctgctgaagacgggagcctcgatcgacgcggtcaccgagtctggcctgacacctctccacgtggcctccttcatggggcaccttcccatcgtgaagaacctcctgcagcggggggcgtcgcccaacgtctccaacgtgaaagtggagaccccgctacacatggcagccagagccgggcacacggaagtggccaaatatttactccagaacaaagccaaagtcaatgccaaggccaaggatgaccagaccccacttcactgtgcagctcgcatcggccacacaaacatggtgaagctcctgctggaaaataacgccaaccccaacctggccaccaccgccgggcacacccccctgcacattgcagcccgtgagggccatgtggaaacagtcctggcccttctggaaaaggaagcatcccaggcctgcatgaccaagaaaggatttacccctctgcacgtggcggccaagtacgggaaggtgcgggtggcagagctgctgctggagcgggacgcacacccgaatgctgccggaaaaaatggcctgacccccctgcacgtggccgtccatcacaacaacctggacatcgtcaagctgctgcttccccggggcggctccccgcacagccctgcctggaatggctacacccctttgcacatcgctgccaagcagaaccaggtggaggtggcccgtagtctgctgcagtatgggggctcagcaaacgccgagtcggtgcaaggtgtgacgccccttcacctggccgcccaggagggccacgcagagatggtggctctgctgctctcgaaacaagccaatggcaacctggggaacaagagcggactcactcccctccatctggtagcacaagaaggccacgttccagtggcagatgtgctgatcaaacacggcgtcatggtggacgccaccacccggatgggctacactcccctccatgtggccagtcactatggaaacatcaagctggtgaagtttctgctgcagcaccaggcagatgtcaatgccaagaccaagctaggatacagccccctgcaccaggcagcccagcagggacacacagacatcgtgactctgcttctgaaaaacggtgcttccccaaacgaggtcagctcggatggaaccacacctctggccatagccaagcgcttgggctacatttctgtcaccgacgtgctcaaggtcgtcacggatgaaaccagtttcgtgttagtcagtgataagcatcgaatgagtttccctgagacagttgatgagatcctggatgtctcggaagatgaaggggaagaactcatcagcttcaaggctgagaggcgggattccagggatgttgatgaagagaaggagctgctggattttgtgccgaagctagaccaagtggtggaatctccagccatccccaggattccctgtgccatgcctgagacagtggtgatcaggtcagaagagcaggagcaggcatctaaagagtatgatgaggactccctcatccccagcagcccggccaccgagacctcagacaacatcagcccggtggccagcccggtgcatacagggtttctggtgagcttcatggttgacgcccggggtggttccatgagaggaagtcgccacaacggcctgcgagtggtgatcccgccacggacgtgcgcagcgcccacccgcatcacctgccgcctggtcaagccccagaagctcagcacgccgcccccactggccgaggaggagggcctggccagcaggatcatagcactggggcccacgggggcacagttcctgagccctgtaatcgtggagatcccgcactttgcctcccatggccgtggagaccgcgagctcgtggttctgaggagcgaaaacggctccgtgtggaaggagcacaggagccgctatggagagagctacctggatcagatcctcaacgggatggacgaagagctggggagcctggaggagctagagaagaagagggtgtgccgaatcatcaccaccgacttcccgctgtacttcgtgatcatgtcacggctctgccaggactacgacaccatcggtcccgaagggggctccctgaagagcaagctggtgcccctggtacaggcaacgttcccggagaatgccgtcaccaagagagtgaagctggctctgcaggcccagcctgtcccggatgagcttgtcactaagctcctgggcaaccaggccacattcagccccattgtcaccgtggagccccggcgccggaagttccaccgccccattgggcttcggatcccactacctccttcctggaccgacaacccgagggacagcggggagggagacaccaccagcctgcgcctgctttgcagcgtcattggaggaacagaccaagcccagtgggaagacataacaggaaccaccaaacttgtatatgccaacgagtgcgccaacttcaccaccaatgtctctgccaggttttggctgtcggactgtcctcggactgctgaggctgtgaactttgccaccctgctgtacaaagagctcactgcagtgccctacatggccaaattcgtcatctttgccaagatgaatgacccccgagaggggcgcctgcgctgctactgcatgacagatgataaagtggacaagaccctggagcagcatgagaacttcgtggaggtggcccggagcagggacatagaggtgttggaaggaatgtccctgtttgcagaactctctgggaacctggtgcctgtgaagaaagctgcccagcagcggagcttccacttccagtcatttcgggagaaccgtctggccatgcctgtaaaggtgagggacagcagtcgagagccgggagggtccctgtcgtttctgcgcaaggcgatgaagtacgaggacacccagcacattctctgccacctgaacatcaccatgcccccctgcgccaagggaagtggagccgaagataggagaaggaccccgacgcccctggccctgcgatacagcattctcagtgagtccacaccaggttctctcagtgggacagagcaggcagagatgaagatggctgttatctcagagcacctcggtctcagctgggcagagttggcccgggagctgcagttcagtgtggaagacatcaacaggatccgagtggaaaatcccaactccctgttggagcagagtgtggccttgctgaacctctgggtcatccgtgaaggccaaaacgcaaacatggagaatctgtacacagccctgcagagcattgaccgtggcgagatcgtgaacatgctggagggttccggccgacagagccgcaacttgaagccagacaggcggcacaccgaccgcgactactcgctgtcaccctcccagatgaatggttactcctcactgcaggacgagctgctgtcccctgcctccctgggctgtgcactttcctctccgctacgtgcagaccagtactggaatgaggtggccgtcctagacgccatccccttggcggccacggagcatgacaccatgctggagatgtctgacatgcaggtgtggtctgcgggcctcacgccttctctggtcactgctgaggactcctctctggagtgtagcaaggctgaggactctgatgccacaggtcacgagtggaagttggagggggcactctcagaggaaccgcggggccccgagttgggctctctggaacttgtggaggacgacacagtggattcagatgccacaaatggccttatcgatttgcttgaacaggaggaaggtcagaggtcagaagagaagctgccaggttctaagaggcaggatgacgcgacaggtgcagggcaggactcagagaatgaagtgtctcttgtttcaggccatcagagggggcaagcccgaatcacacattcccccaccgtgagtcaggtgacggagaggagtcaggacagactgcaggactgggatgcagacggctcgattgtctcatacctgcaagatgctgcacaaggttcctggcaagaggaggtcacgcaaggtccacactcattccagggaacaagtaccatgactgaagggctagagcccggtggatctcaggagtacgagaaggtcctggtgtctgtaagtgagcacacgtggacagaacagcccgaggctgagagctcccaggccgacagggaccggaggcagcaaggccaagaagagcaggtgcaggaggccaagaacaccttcacccaagtggtgcaggggaatgagtttcagaatattccaggggagcaggtgacagaggagcaattcacggatgagcagggcaacattgtcaccaagaagatcattcgcaaggtggttcgacagatagacttgtccagcgccgatgccgcccaggagcacgaggaggtggagctgagagggagtggcctacagccggacctgatagagggcaggaagggggcgcagatagtgaagcgggccagcctgaaaagggggaaacagtgaccccgagccgctctccttggagtagcctctcgggaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctggaaagaaaaaaaaaaaaaagaaaactaggcatgaaatcagtttaacaccttaatcttaagccatgtcctcatctgcccaccctccccaacccacatacctccattccacttgtgacaccccctcgactccctggtgacgctcctcccagatcgctctacatgacattcaggacacacacacacacacacacacaccactcgcctccactgaatctacacacagattttactgtgacttctgaagctgtatagactctgctgtggataaattggaattttttatgttgtctctctctctgccaatttcaatacgaatcatcttccaatggaaaatcattaccttgaagagtgcattcggggttccttgtgttagggacttaagaatctgaggcgaggacccccaggcttacctgtaggactcaaagggagccaggaccccatctgaaagggtctcctctctcagttgggggacaggccggtggctgacccaggattgcaccagcatgtccatagagaagaggttttctatgtcttcaagcactatatcatagtccgtgttcaaagtgtaaactgtacagtaatcagccttgtgtatatgaaaaacaataaatactatgcaaaccaatagaaacatttagcagtacgtacagagcctgacagcgcagctcctgaggacttctgcggctgcaggagaaggagctgtggcctgtctttcagtgaaagaggaaggaaaggagtagggctagtgaatgtatctgccaggtcttagaagtcaggaccacccagggtctcccagagtgaacttggtgctctaagtccaggcagcctgcaggctggggaccctgggtgcaggtgccaggctcgaggctgttccctgtcctgcctcagtgcctcccctctgcccagcccctgtggcctcttggagaggcgagccagggggctccccggaccgcatggccggtgagagtagagtcggaggcggagagcctggacgcccagaggccggggccaggctctgggtcaaggcaggaaggagacagacagctggcagttcctcgcctcggtgccatcagggaggagccttaagttccactagagcctccggcccagggaggccagaatcagcacaatcccggccccgccctcgcggcgggcgcccccagggccaggagagagagacagggctggctcctctcgcccctggagccgcggtgtggacggcccggccccgtccgccccgccgctctgcgggagtgtcctcgggacacacttaaaccttccaagtagcacagaagccccctccacgtcagaggccccctggccgcggggcctgtgagcggagaggggccctgcttcccacacaaatccgccccggtgcacccccggccaggcaggccccggggcggcctaggcgccttgtcggccgggggtggggctgcttttgcttcctttagaggggcgggcagggagaggaagctctagctccgggcctgagtttccccgaggctgcgtcggaggagctgcagggcgagcccggacggctgccgtctccgccagaggccaccccggcccggcctccagggcgcagaggcgcccccctccatcctcccccatcccgggggccacggcaggggggccgcacagcgcggctgggaccgattcggtgacggcccaaggaagctgggctcagggctcgcctctcccgcctcgatcctgcaccttcctctcccaggtcgctgctgcagccaacccagtagcccccttagcgcccccgcggaccccgcagctccagactccgctttggcacctctgctccggctggcatggctgcacgctccggctgctagtaggagccgttaggggaggagtttggggtctccacacgatgcctagagaatgctgcagtctgcacattagacgctttttagaagttttgaaattaccttgatttttttaattgttatgaaaatggatcttttcttgactctcccacatgctctgttatgggagagaatcccctaccctactctgatgtatagaccattctcccttcaccagccgaaccaatgtcaaaattaataaagaaatggactaatggcaaaaaaaaa

SEQ ID NO: 430 - DNA, 2126 bp, Human
ggcagccgcggtccatcgcgttcgggggcgacgcggggattggggcgcggcctcccccagcgcccgggccacgcccggcacggattgcgggccctgcggaagtgcgggccgcgccctaggatcccggcgcctacggctatcctcgcgcggcgcggaggccccagcccctggaggaagcagggcggcctggaccccggcctgggtgtcccgggtgtgctgctccctgacccacctcccacgctgccgggaaggatctgagcctgacagatcccctgccgggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtcccccccagcccctcccctccccataccaaagtgctgacaggccctccgtgcccctcccaccctggtccgcctccctggcctggctcaaccgagtgcctccgacccccctcctcagccctcccccacccacaggcccagcctcctcggtctcctgtctcgttgctgcttctgcctgtgctgtgggggagagaggccgcagccaggcctctgctgccctttctgtgccccccaggttctatctccccgtcacacccgaggcctggcttcaggagggagcggagcagccattctccaggccccgtggttgcccctggacgtgtgcgtctgctgctccggggtggagctggggtgtgggatgcacggcctcgtgggggccgggccgtcctccagccccgctgctccctggccagcccccttgtcgctgtcggtcccgtctaaccatgatgccttaacatgtggagtgtaccgtggggcctcactagcctctaactccctgtgtctgcatgagcatgtggcctccccgtcccttccccggtggcgaacccagtgacccagggacacgtggggtgtgctgctgctgctccccagcccaccagtgcctggccagcctgcccccttccctggacagggctgtggagatggctccggcggcttggggaaagccaaattgccaaaactcaagtcacctcagtaccatccaggaggctgggtattgtcctgcctctgccttttctgtctcagcgggcagtgcccagagcccacacccccccaagagccctcgatggacagcctcacccaccccacctgggcccagccaggagccccgcctggccatcagtatttattgcctccgtccgtgccgtccctgggccactggcctggcgcctgttcccccaggctctcagtgccaccacccccggcaggccttccctgacccagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaaggaaaaaaaaaaaaaaaaaaaaaaaaaaaaaaaaaaaaaaaaaaaaaaaaaaa

SEQ ID NO: 431 - DNA, 4348 bp, Human
cttctcacactttcaggctctgatcgcggccgcagtttttccttttttcttctgccgtcgccttctctgcctcttctcatcctttctcgctctgctgctctgcagtgtgacgagtccgaatcctcttcccacccagcccgcgcctttcttcttttgcctgcgctgttctatttctccttcggccgccgccgccactgctgcacacagctggtgtcggtgccgcgcttttacccccaagtcgttcccgcagcctatggcccaggccgccttgggtatttctgctcaaggtaaccacatccctctttaaaaattccgccgaaaaagagaagacgctttacccgactctttgggccgttatctcacggcgaactttctgaccaagtatacaactacccagagggcctaggagaagtgctgtatagagagcagttcgacttcaacgctgagccaccttgggaacctagctgatgataggggggttccatctcccaacttgtccatggaggtcttcacttcagaaatccaagactcatattcatccagcttggtgtcaagtgggctgttgctgccagaattatcttgtgattatttgagagatgtatcagtttcttctgaagtacaatcaactgtagaagcctttgtagcagtttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacataccctgacagggaaaaatgcattttttgtgggagatcttggaaagattgtgaagaaacacagtcaatggcagaatgtagtggctcagataaagccattctacacagtgaagtgcaactctgctccagctgtacttgagattttggcagctcttggaaccggatttgcttgttccagtaaaaatgaaatggctttagtgcaagagttgggtgtacctccagaaaacattatttacataagtccttgcaagcaagtgtctcagataaagtatgcagcaaaagttggagtgaatatcctgacatgtgacaatgaaattgaattgaagaaaattgcacgtaatcacccaaatgccaaggtcttactacatattgcaacagaagataatattggaggtgaagagggtaacatgaagtttggcactaccctgaagaactgtaggcatctcttggaatgtgctaaggaacttgatgtccaaataattggggttaaatttcatgtttcgagtgcttgcaaagaatctcaagtatatgtacatgctctatctgatgctcgatgtgtgtttgacatggctggagaaattggctttacgatgaacatgttagacattggtggaggattcacgggaactgaatttcaattggaagaggttaatcatgttatcagccctctgttggatatctactttcctgaaggatctggtgttaagataatttcagaacccggaagctactatgtgtcttctgcatttacactcgcagttaatatcatagcaaagaaagttgttgaaaatgataaatttccctctggagtagaaaaaaccggaagtgatgaaccagccttcatgtattatatgaatgatggtgtttatggttcttttgcaagtaaactgtctgaggacttaaataccattccagaggttcacaagaaatacaaggaagatgagcctctgtttacaagcagcctttggggtccatcctgtgatgagcttgatcaaattgtggaaagctgtcttcttcctgagctgaatgtgggagattggcttatctttgataacatgggagcagattctttccatgaaccatctgcttttaatgattttcagaggccagccatttattacatgatgtcattcagtgattggtatgagatgcaagatgctggaattacttcagactcaatgatgaagaacttcttctttgtgccttcttgcattcagctgagccaagaagacagcttttccgctgaagcttaaacaggcattaacgcttctttagatctgaagttgcaggttaagcttgtctggtcaacattccagtgtggaaaaataatttaaacaatcttattctcttaattcttttggcaacaaaaactattagtaatagctatttgggaccagacaaaatcagctttcatctataattcattggggataatgggagatttagataatgtatccagatttaaacctaccagtttgtcctaccccttaagcgtttaaaataaaatatgcaacaaaatggatgacttagtggagatggaagcccattaattgggttccccattaaatcgtttacatacaagaacacagtttttatactaaggatttgtgtttaaagtcttgtaaagttcatgtctttcacccagatatatcaaatgttagaagaccagtgtgacttcattagataacgtttagtgtatttagaatgtgtaaatttgtgctttgaactgtagtttaataaatgtaaaattgcatcatagtatttgttgacctaatgtaacccttgtatgattgcaataaaattttgtgtagattttactgttttttcaggctaaaactttgggaaaggggctagctagcaaaggtagttttgaaatagatgtgtatatggactgttttgaagggtttttttctttatagcccagttaagttttgtttggctcggtgcatttttcatttatttaattagtaatttaagtaaagtgtttggtaaatcattgtgaagttcagattcattatggagagttgatgtgcagtaagcatgatgtttaacaattttaacaccaaaaatgttaatcctgcataaatcaactgtaataataaataggtgtttctgtatagatagaatgcatagagtaccttagtaaatctttgaatcacaatcttttggctgaaatggaagattctgttaaatactttgaataaacttggggggagggaaataaaattgcagaaaactgcagagcactaaaacttaaagaagggctacatctttatccagaaacctgttgctcttttgcacggaatgtttaaattcagagttgggatgggggttggggtgaagcacacttattatcttcagttgcagtgatttcaaatttaggattttttgttgttggtttgaactgtccccttagtttcttgttatttccaatttgttctgcttagtcattacttttaattcttttcttactaaaattttatggtggttgggggaagggagttagcatcactaacctgacagttgttgccaggaatttgctttgtttactgctagtatattagaaatcctagatctcagaatcacaatagtaataaacaacaggggtcattttttcctaacttactctgtgttcaggtgtggaatttctgtctcccaagaggaaatgtgacttcactttggtgccaatggacagaaaattctacctgtgctacataggagaagtttggaatgcacttaatagctggtttttacaccttgatttcgaggtggaaagaaattgatcatgaatctctaataaatttaaatctcttaaaccagtaggtgcttaatattttttgatttgattaatgcccatttaaatctcatgggttctattaaaaatatatatatatagggccccaatccattgccatcaaattgcccttggacttttccaaggtatattatggggttttatgcaaaattccaagctaccatgtaactttttttaaccatttaacaaggagggggaactgtttcctaccttctttacatgttgtgcattgttgtggtccagaaatgccaaacctttttaaagatggtgcaactttgagtccttggcttgactatacaggccttgaacttcatggcatatcaactttgccatatctgcaggagagctgttctataagaaatagctcagagttgcaaatatcacatgtgaatgatacggtaacttttaagaaatgtctgtattgtatttgaagactgtttgccataaatctgaaatttgaacctatgtatttcaatttggtatgctaaaaagttctgaattaatgtaaagttttttgttataatattgtaatctcagttcaaaagttaactgcaaatataaaacccaatgatttctatatagtaaattgaactgtaaaggtaacttgtgtgtgattctgaatacatagataaatgtttttattcctcatgttttactttggcttctatctgaaatagaggtaaaattttacatatca

SEQ ID NO: 432 - DNA, 1486 bp, Human
gtcgcggaacccggaagcgggggtgcagcgcggcagaatgagggttgattcctcggctgaccccacaatgtcgcaggagcaagggccggggtcctccacgcctcccagttctccgacacttcttgacgctctgctccagaacctttacgactttggaggtacagaaggtgaaacagaacagaagaagatcataaagaaaagggaaaacaagaagagagatgtgatggcttcagcggccttggcagcagagccatctcccctacctggttctctcataagaggccagaggaagagcgcttcgagcttcttcaaggaacttagagaagagcggcattgtgctccttctgggacccccacaggaccagagatccttgctgctgcagttcctccctcttccctaaagaacaatagggaacaagtagaagtggtagaatttcacagcaataaaaaaagaaaattgacgccagatcataacaagaacacaaagcaggctaatcctagtgttttggagagagatgtggatacacaagaatttaacctagaaaaagctcgtttagaagtgcaccggtttggtatcacgggttatggaaaaggaaaggagagaatcctggaacaggaacgtgccattatgctgggcgctaagcctcctaaaaagagttatgtgaattacaaggttttacaggagcaaattaaagaaaaaaaggcagcaaaggaagaagaaaagagactggcccaagaaacagatattttcaagaaaaagaagaggaaaggacaggaggacaggaaatccaaaaagaagtccgctcccagtattttgtcaaatggacggattggacaggttggaaaattcaaaaatggaacactgattctgagcccagttgatatcaagaaaataaattcttccagagtggccaaatgaagtactttgtcaaataaaacgaggatgggaacaactgagtcaactgcagcggccctggaccctgtgcgactctagatagatcgttcttaacacgcatttcacagactgctttttcattttagaaaaaaagtcaaacagaagtaacatttctagttgccgaagtgtctgcttcatggtgctgaacgtgtcaggcccagtgcagcatgaatgtgaagtgaacccactgaaaagtgatttttaatgttctccagcaaacttcactcctgtttcatgttcactggtatttggtgcatttgcttgtaatacagttttttataactttactgttttgtaaatgctagtagtttacattaaattgccttatatttttaatgatttaatgttatgatatcatgaaagaaccaagaatctagtaatttatcagttttgtggaaaagcagttttaatttttagcctaccatgtgtacaaaatctacttcataagaagttatataaataaaataggtttgtagtataaaaaaaaaaaaaaaaaaaaaaaaaaaaaaaaaaaaaaaaaaaaaaaaaaaa

SEQ ID NO: 433 - DNA, 723 bp, Human
ccggcctctgggcggagatctgctgccgcgttctacccttccggcccgtgttctatccgccgcctccaccttccatccggcgccggctttcggcgcgacggtcgccgcgttccatcgtcgcgcggcccttcgggcgcccgagcccgcaatgtcgggccccaacggagacctggggatgccggtggaggcgggagcggaaggcgaggaggacggcttcggggaagcagaatacgctgccatcaactccatgctggaccagatcaactcctgtctggaccacctggaggagaagaatgaccacctccacgcccgcctccaggagctgctggagtccaaccggcagacacgcctggagttccagcagcagctcggggaggcccccagtgatgccagcccctaggctccaagagcccccaaccgggacccaaccctgcctccctgggctaggctctggcctgggcactcaccccctggcttagacaccttctcaagggctggccttcagggacccctggtgggtctgcctgcctgggccacccttcctgcctgggcctccccttggcctacctgggccagcccccaccacctggcatgccctcctggggccaagagtgggcctgcaacccacccacttgcctgcccacccaactcctgggcgctccccactctgcccaggccttgagtgtccacattaaatgggtctcccacaccgcaaaaaaaaaa

SEQ ID NO: 434 - DNA, 2330 bp, Human
cccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgtaatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctgctgacaaaccaagaggatttgccagaggtcttgatcctgaaagaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttttgtgtgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttgagtttgctttactggttcagcaaaagccaggaagaacaactttgtagtaatcaaaatgttatccaactgtatattgtttactttattgtaaatactggtgaacagtggttaataaatagttttatattcctttatgcaattattagacttttttctttatttgatatgcctttacagtagaaatagaaatgcccacactcattggattatctttgtttataagttagatgataccagtaaggcattacagtacatatcctagatcttttgagcttacgagttttaaacttgaatatgtatttccacaggaatgtttccacagttgggaaataaaagtttcatgtgatgcctagggtcaattgtctcattaaaatgaggttttaaattctg

SEQ ID NO: 435 - DNA, 2450 bp, Human
gcacggtgcccgctctaccccgccgcagcggctgggacgtacggagcccgcaagtcccggcccgaggtccgaggaggcgtcctccgcccggtggcccagagggaagcggggcacggcgtcatcatgcacagttgtatcgcgcccgccgcgcgtccccggagccgcccctgagcccgaccgcgagttcgagctcagggcccgcccggccgcaccatgagccacgggcccagcccccggctggccgagtccccgcagctgtccaagggcagcctcctgaccatcctgggcagcccgtcgccggagcgcatggggcctgccgactccttgccgcccacgccgcccagcggcacgccctcgcccgggccgccgcccgcactgcccctgccccccgcgcccgcgctgctggccgacggcgactgggagagccgcgaggagctgcggctgcgggagctggaggaggcgcgggcgcgggcggcgcagatggagaagaccatgcgccggtggtcggactgcactgccaattggcgcgagaaatggagcaaggtgcgcgctgagcgcaaccgcgcgcgcgaggaggtgcgccagctgcgccagcgcctggacgcgctcaccaaggagctggcgggcgcacggcgcgagcgccaagaggcgcagggcgagtgcgaggcacggggccgcgagctggcgcggctgaggggcgcccggggggtcgccgaccagacgcgcgacggccccgagccggaagcggagcgcgagccagtgcgtgacgtcgggtccgagaggccgccaggcagccaggaactggagctggtggagagcctgctgaagagcatgccagaggagtctgaggactgctgggaggcgcgcagcctgggggctgggggcccgcggggcagctcaggccgccaggagcgcagccggctaccctgggaggacacagctgccacggaggaggaggcctccaagttgaccgccctgcggctacggctggatgagtcccagaaggtgctgctcaaggagcgagaggataaactggcgttgagcaggaacattgagaagctagagggggagctcagccagtggaagatcaagtatgaggagctgagcaagaccaagcaggagatgctcaagcagctcagcatcctgaaggaggcgcaccaggacgagctgggccgcatgtctgaggacctggaagatgagctcggtgcacgctccagcatggaccggaaaatggccgagctgaggggcgagatggagcggctgcaggccgaaaacgctgcggagtggggccgccgggagcggctggagacagagaaactgggccttgagcgggagaacaagaagctgcgggcacaggtcggagacctggaggaggcgctggcccggcggcggcggcaaacagccagcgcactggactgcgacctgagggccagccaggccgcgctcttcgagaagaacaaggagctggcagacctgaagcatgtgcatggcaagctgaagaagcagttccaggagaaggtggcagagctggcacatgccaaccggcgggtggagcagcacgaggctgaggtgaagaagctgcggctgcgggtggaggagctcaagaaggagctggcccaggctgaggacgagctggacgaggcccacaaccaggcacgtaagctgcagcggtcgctggacgagcagacggagcagagcgagaacctgcaagtgcaactggagcacctgcagtccaggctccgcaggcagcagcagaacgctcccctcttcgggaagatccgcagtgctcgctttggcaccgaggaggccgaggatggaaccagtgacctggacgaggacgaggacctgcaaatccaggtggcctagagcttcctgtggctgggcaggatgggccgccccatacctgcccagggtccaggctaaccagccactcaaactgatgcagtgcctaggctcactctgggaccagtccctgccacagccgactttcttctctcccagggatggcgtcaacagtcccacctaccaacgccctgtggaaaggaagcctatgttttatatatatatatacacacacgcgcgcgcgcgcgcgcacacccagaagtctttggacccatttggttttataaatacaggacagctccaaggcccagtccagatgacctcacccacccaggacttcatgcagggctgggcatgttgggggcagttgttggagccccaccctgggctgcctctctaggcttcgctgttcatcatacaatgcagtgaacccagttatttgtaataaatgaagttcaagttcttggggcatctgaaagtatggcagatgtgggcgggggttgtgggggacggcatcggcctgcacctgacgctgaaccagagctcaggaatgtcaagtaacttaataaatgagtgaatgtgaagaaaaaaaaaaaaaaaaaaaaaaa

SEQ ID NO: 436 - DNA, 3669 bp, Human
gaggcggggccaggcctggtctctgataacgggatgggtggtgctggacctcgggcggggccgggcctcgtggcgggaggaggcagggcagggcctctgggacggggctggacggcttgttgacggaaacgagcccttgacgctgtggcccggaagtggagcggctgtcgcagtgcggctccggcagtggcagcggaggcctgtgtttgcggccttcggcaagcgactgagatggcgagcgcaactgcacctgcagccgcagtccccaccctggcttcgcctttggagcagctccggcacttggcggaggagctgcggttgctcctgcctcgagtgcgggtcggcgaagcccaggagaccaccgaggagtttaatcgagagatgttctggagaagactcaatgaggcagctgtgactgtgtcaagggaagccacgactctgaccatagtcttctctcagcttccactgccgtctccacaggaaacccagaagttctgtgaacaagtccatgctgccatcaaggcatttattgcagtgtactatttgcttccaaaggatcaggggatcaccctgagaaagctggtacggggcgccaccctggacatcgtggatggcatggctcagctcatggaagtactttccgtcactccaactcagagccctgagaacaatgaccttatttcctacaacagtgtctgggttgcgtgccagcagatgcctcagataccaagagataacaaagctgcagctcttttgatgctgaccaagaatgtggattttgtgaaggatgcacatgaagaaatggagcaggctgtggaagaatgtgacccttactctggcctcttgaatgatactgaggagaacaactctgacaaccacaatcatgaggatgatgtgttggggtttcccagcaatcaggacttgtattggtcagaggacgatcaagagctcataatcccatgccttgcgctggtgagagcatccaaagcctgcctgaagaaaattcggatgttagtggcagagaatgggaagaaggatcaggtggcacagctggatgacattgtggatatttctgatgaaatcagccctagtgtggatgatttggctctgagcatatatccacctatgtgtcacctgaccgtgcgaatcaattctgcgaaacttgtatctgttttaaagaaggcacttgaaattacaaaagcaagtcatgtgacccctcagccagaagatagttggatccctttacttattaatgccattgatcattgcatgaatagaatcaaggagctcactcagagtgaacttgaattatgacttttcaggctcatttgtactctcttcccctctcatcgtcatggtcaggctctgatacctgcttttaaaatggagctagaatgcttgctggattgaaagggagtgcctatctatatttagcaagagacactattaccaaagattgttggttaggccagattgacacctatttataaaccatatgcgtatatttttctgtgctatatatgaaaaataattgcatgatttctcattcctgagtcatttctcagagattcctaggaaagctgccttattctctttttgcagtaaagtatgttgttttcattgtaaagatgttgatggtctcaataaaatgctaacttgccagtgattaaatgagtgcccttccaaagtttctttttaccagaaatacagtggattgagactagaacattgctttcatttgggtttgtaggtttaaaaatctgattctaatcagaagtatatttagaacaaaacactttatttataaaagatgactccaaaattcatcttagtatttcaccatgttatatattattatcagcaagtccttctgaatattatcacagattactccatgtctctaaaatatattggcattgagctcatttgttaggtttgcccaccttattgaacagatttattttccttatacatacttgtgttgtccttggttacgtgtgtccccaaatgtaaataccaaatttttataaatcaaaaattttttagtgtgtaagagattttatgtaattttaagggccttttcagttcatccttttgcaaaaccatcaccacttaattatacttttgcatcagtctagaagactgcatattggaaagcagtgtaaatctataatgatgtatattctggtgagctgaatagggcattatgcatgtcctacaggtctccgccacctctcatgcccatcatcttccttttgtaggtgtaattcataacatatgcctttctgctgtctttaggtataatcagcaacagcagtcattctttgagtgactaatgtatacttggggttggggttgaaattccttaagccaaatgagttttagcttactgttttgaagtgccattttgtattgttaacaagtgtcatgaagggaaggaactaaaatcaaactgacagagtgtcaaggcaacaaaataacataaacaaaataataacattgtacaacagtctagttcttttatcctttcatatagagcctattttttatatacttttatatttctctactggaccaaattcatgttattaacatcagactttaattgtgggatacttaatgaatatagaactctaatataaagacttacctctagctgaattattctctcaggtcctgtattgtataacttcgttcagtcatgtttggatctttaaggataatgatcagggaaagcactgatcaatgtaatttttttttttttttttttttttttgagatggagtcttgctctgtcccccaagctggagtgcagtggcacactctcggctcactgcaacctccgcctcccaggttctcaagcaattctctggcttcagcctctcaagtagctgggactacagatgcacaccaccatgtccagctaatttttgtatttttagtagagatggggtttcaccatgttggccaggctggtctcaaactcctgacctcaggtgatctgcccacgtcagcctcccaaagtgctgggattacagatgtgagccaccgagcccagcttgatcaatgtaattttaagattacctaaaaattccattttgggataatatcccacttcatcagaaatattagaatgatttaagtgttaggtcctttcccttatctgtaagttaatgaatgtattaatgagcagtaaaatggttgcaaaaaacctgaacctgaacaatctgaatgtactccttaaaggtatctgagcaccttttcaacctgaatgactactcatttatctgataaagtgatgtagtttggatattcaaccctgcaaacctcatgctgaaattggattcccagtgttggaggtggggcctaatgggaggtgtttggatccctcatgaatggcttcgttccattggtggggtaatgagtaagttctcgctctatatgtccctcccccaccccagagctggctgttaaaacgaggctggcacctggcacttacccctacccctcaacccattcttgccctgtgatctctgctcacgttgcctcccttcatcttcctgcataagtggaagcagcctgaagccctcactgtttcttgtacagcctgcagagccgtgagccaaataaagctcttttcttttaaactaaaaaaaaaaaaaaaaaaaa

SEQ ID NO: 437 - DNA, 1405 bp, Human
tttcccggcgtccatttagtggcgggaaaagcgaccttttctgagcgcgtttgcctgttgagtggtagcctttcccctcaaccagcaatggaggagcagccccagatgcaagacgccgacgagcccgcggactccggaggggaaggccgggcaggcgggccaccgcaggtcgccggcgcccaggcggcgtgcagcgaggaccgcatgaccctgctcctcaggctgagagcacagacaaaacaacaactcttagaatataaatcaatggttgatgcaagtgaagaaaaaactccagaacaaattatgcaagaaaagcaaatcgaagctaaaattgaagacctggaaaatgaaattgaagaggtaaaagttgcttttgagataaaaaagcttgcattagacaggatgagactttcaactgcacttaaaaaaaacctggagaaaattagcagacagtctagtgtgctcatggataacatgaaacacctattagagctaaataaattaataatgaaatcacagcaggaatcttgggatttagaggaaaaactgcttgatattagaaagaagagattgcaattaaaacaagcttcagaaagtaagcttttagaaatacagactgaaaagaacaaacagaagattgatttggacagtatggaaaactcagagaggataaagatcatacgacaaaacctacagatggagataaaaattactactgttattcaacatgtgttccagaaccttattttggggagtaaagtcaattgggcagaggatcctgcccttaaggaaattgttctgcagcttgagaagaatgttgacatgatgtaataagaattcatttctgacatattttacatttctggcaatctcaactcttatttggaatacttctgtgcatttgtctgtccaccgtaattttagaaaagcatatccataacgtttacagttgtagtacagttgtggttagttatttgtagtgggattgaaagtaatttttttctttttatatttctatatttagtttgtttttttgttgttgttgttttttgagatggagtctcgctttgttgcccagactggagggcagtggcgcgatctcggctcactgcaacctctgcctcccgggttcaagcagttctgcctcagcctcccaagtagctgtgactaaaggtgcacgccgccatgcccagctaattttttgtattttagtagagacggggtttcaccgtgttgcccaggctgctctcagaactcctgagctcaggcagtccaccgcctcggcctaccgaagtgctaggattacagacgtaagccaccgagcctggtctagtttgcattttttttctatcagttttataagttaagaaataaaaggaattaatgttaaaaaaaaaaaaaaaaa

SEQ ID NO: 438 - DNA, 3800 bp, Human
gaagaggtagatagtgctggaaggcgtgctaggtacaccgcaaagactccacagcaaatcctgcacacaaaatcgcgaatgctgcagccgagaccccacgcaagcaagcaccgcaggagacgtgggctgacagctgcgccccacgtgacctcccacccgcgccagtccgtcccctcggtatcagggcgtggcctcgcggggcggccgtacctggattggccgggaggcgggaccggtggtgcgcgcgcgaaaggagaggggcttgggggcgtggcccagggggccggagacggctgcgattggcagtggggcgcgccgggggcgtgaccgcggcattgggtcccgggtggggccgaggcagcgggagtcgcggttgctcagcgtgcacctgagacccgacgcccggggtcctcgaagacgcgtccgccgccgtgcccgtcgccatgaaccgcttcagggtgtccaagttccggcacaccgaggctcggccgccccgccgcgagtcctggatcagtgacattcgagcaggaaccgccccttcatgcaggaaccacatcaaatcaagctgcagcttgatcgccttcaactccgaccgtcctggtgtactgggcattgtgcctctgcaaggccaaggagaggacaagcgacgcgtggcccacctgggctgccattcaggctcggctgacaggacggtaaaactctggcgactgccagggcctggccaggccctgccctcagcacccggggtggtgctgggccccgaggacctcccagtggaggtactgcagttccaccccacctctgacggcattctggtgagcgcagcaggcaccactgtgaaggtctgggacgcagccaagcagcagcccctgacagagctggcagcccatggggacctggtgcagagcgccgtctggagccgagatggagccctggtgggcacggcgtgcaaggacaagcagctgcggatctttgaccccagaacaaagccgcgggcctctcagagcacgcaggcccatgagaacagcagggatagccggctggcatggatgggcacctgggagcaccttgtgtctactggattcaaccagatgcgtgagcgcgaagtgaagctgtgggacacgcggttcttctccagcgccctggcctccctcaccttggacacctcgcttgggtgtctcgtgcctctgctggaccctgactctgggctcctggtcctggcaggaaagggcgagaggcagctgtactgttacgaggtggtcccgcagcagccggcgctgagcccagtgacccagtgtgtcctggagagcgtgctgcgtggggctgcccttgtgccccggcaggcgctggccgtcatgagctgcgaggtactccgcgtcctacagctgagcgacacagccatcgtgcccatcggctaccatgtgccccgcaaggctgtggagttccacgaggacctgttcccggacactgccggctgtgtgcctgccaccgacccccatagctggtgggctggggacaaccagcaggtgcagaaggtcagcctcaaccccgcctgccggccccacccgagcttcacttcctgtctggtgccccctgcggagcccctccctgacacagcccagcctgcggtgatggagacacccgtgggtgatgcagacgcaagcgagggtttctcttcccctcccagttcgctgacctcgccctccacgccctccagcctggggccctcactctccagcaccagtggcatcgggaccagccccagtttgaggtcgctgcagagcctgctgggccccagttccaagttccgccatgctcagggcactgtcctgcaccgagacagccacatcaccaacctcaaggggctcaacctcaccacacctggtgagagtgacggcttctgtgccaacaagctgcgtgtggccgtgccgctgctcagcagcgggggacaggtggctgtgcttgagctacggaagcctggccgcctgcccgacacggcactgcccacgctgcagaatggggcagctgtgactgatctggcctgggacccctttgacccccatcgcctcgctgtggctggtgaggacgccaggatccgactgtggcgggtacccgcagagggcctggaagaggtgctcaccacgccagagactgtgctcacaggccacacggagaagatctgctccctgcgcttccacccactggcagccaatgtgctggcctcgtcctcctatgacctcactgttcgcatctgggaccttcaggctggagctgatcggctgaagctgcagggccaccaagaccagatcttcagcctggcctggagtcctgatgggcagcagctggccactgtctgcaaggatgggcgtgtgcgggtctacaggccccggagtggccctgagcccctgcaggaaggcccagggcccaagggaggacgcggagctcgcattgtctgggtatgtgatggtcgctgtctgctggtgtctggctttgacagccaaagtgagcgccagctgctcctatatgaagctgaggccctggccggcggacccttggcagtgttgggcctggacgtggctccctcaaccctgctgcccagctacgacccagacactggcctggtgctcctgaccggcaagggcgacacccgtgtattcctgtacgagctgctccccgagtcccctttcttcctggagtgcaacagcttcacgtcgcctgacccccacaagggcctcgtcctcctgcctaagacggagtgcgacgtgcgggaagtggagctgatgcggtgcctgcggctgcgtcagtcctccctggagcctgtggccttccggctgccccgagtccggaaagagttcttccaggatgacgtgttcccagacacggctgtgatctgggagcctgtgctcagtgccgaggcctggctgcaaggcgctaatgggcagccctggcttctcagcctgcagcctcctgacatgagcccagtgagccaagccccccgagaggcccctgctcgtcgggccccatcctcagcgcagtacctggaagaaaagtctgaccagcaaaagaaggaggagctgctgaatgccatggtggcaaaactggggaaccgggaggacccactcccccaggactcctttgaaggcgtggacgaggacgagtgggactagcctgcgcccccgtcacctccacctcacctgtgctgccacttcctagtgcacacctcacggctcatcctcaagctggaagatacctctctggccccggcacatgtcacccctgcactcctgccttcccgtgggcacttccacatcctctgggcctctggcagttcccagggactgttttcacctctgctgtctctggggtcagctgctgctcatcagctgcccgctagcatgtggccaggggtgcagggtggcggggggtcagcagcatgtccctgggcaggccctgggcaccctgtctcccctggtctcactgctgacctgggctggtcccagcctggattggcctcatccaggatctttggtcaccccacgctgccccatcttgcctgctgttccagttctggtcaagggccttgggggctggccccccaccaggccttctagagcagcaccagtctcagggccctgggaccagctgccctacttcccaggtttgtagccaggagaagggggcatcacagagctgatggtccaataaggggggtgtgagccccgcagggactggcccgcacctgccttggatgttttcagcaattaaacttttttaagctggccaaaaaaaaaaaaaaaaaa

SEQ ID NO: 439 - DNA, 2755 bp, Human
ctaatcaccaaacatctgcttccttctctgtagctgtgaccctgataccgcgtggtgtgctccgaacacatggtgcccagaacgaaggcggcgtccagaagccctaggtcccagaggtccgctcagcggcaggcgcataaggcggggccggcgcgggcctttccttccatcggaaccgttctcccggggctgagtccctgcccggactccgaacgccgaagaccaggggccggaagcgcgcgccgccactgccacgccgtgtcagtcgggagggagggagcgagcaggcgaagccgcggaggacggggtgaagatggcggccttctccgagatgggtgtaatgcctgagattgcacaagctgtggaagagatggattggctcctcccaactgatatccaggctgaatctatcccattgatcttaggaggaggtgatgtacttatggctgcagaaacaggaagtggcaaaactggtgcttttagtattccagttatccagatagtttatgaaactctgaaagaccaacaggaaggcaaaaaaggaaaaacaacaattaaaactggtgcttcagtgctgaacaaatggcagatgaacccatatgacagaggatctgcttttgcaattgggtcagatggtctttgttgtcaaagcagagaagtaaaggaatggcatgggtgtagagctactaaaggattaatgaaagggaaacactactatgaagtatcctgtcatgaccaagggttatgcagggtcgggtggtctaccatgcaggcctctttggacctaggtactgacaagtttggatttggctttggtggaacaggaaagaaatcccataacaaacaatttgataattatggagaggaattcactatgcatgataccattggatgttacctggatatagataagggacatgtcaagttctccaaaaatggaaaagatcttggtctggcatttgaaataccaccacatatgaaaaaccaagccctctttcctgcctgtgttttgaagaatgctgaactgaaatttaacttcggtgaagaggaatttaagtttccaccaaaagatggctttgttgctctttccaaggcaccggatggttacattgtcaaatcacagcactcaggtaatgcacaggtgacacaaacaaagtttctccccaatgctccgaaagctctcattgttgaaccttcccgggagttagctgaacaaactttgaacaacatcaagcagtttaagaaatacattgataatcctaaattaagggagcttctgataattggaggtgttgcagcccgggatcagctctctgttttggaaaatggagtagatatagttgtaggtactccgggaagactagatgacttggtgtcaactggaaagctgaacttatctcaagttagattcctggtcctggatgaagctgatgggcttctttctcaaggttattctgattttataaataggatgcacaatcagattcctcaggttacctctgatggaaaaagacttcaggtgattgtttgctctgccactttgcattctttcgatgtaaagaaactgtccgagaagataatgcattttcctacatgggttgacttaaaaggagaagactctgttccagatactgtacaccatgttgttgtcccagtaaatcccaaaactgacagactctgggaaaggcttggaaagagccacattagaactgatgatgtacatgcaaaagataacacaagacctggtgctaatagtccagagatgtggtctgaagctattaaaatcctgaaaggggagtatgctgtccgggcaatcaaggaacataagatggatcaagcaattatcttctgtagaaccaaaattgactgtgataacttggagcagtactttatacaacaaggaggaggacctgataaaaaaggacaccagttctcatgtgtttgtcttcatggtgacagaaagcctcatgagagaaagcaaaacttggaaagatttaagaaaggagatgtaagattcttgatttgcacagatgtagctgctagaggaattgatatccacggtgttccttatgttataaatgtcactctgcccgatgaaaagcaaaactacgtacatcgaattggcagagtaggaagagctgaaaggatgggtctggcaatttccctggtggcaacagaaaaagaaaaggtttggtaccatgtatgtagcagccgtggaaaagggtgttataacacaagactcaaggaagatggaggctgtaccatatggtacaacgagatgcagttactatctgagatagaagaacacctgaactgtaccatttctcaggttgagccggatataaaggtaccagtggatgaatttgatgggaaagttacctacggtcagaaaagggctgctggtggtggaagctataaaggccatgtggatattttggcacctactgttcaagagttggctgcccttgaaaaggaggcgcagacatctttcctgcatcttggctaccttcctaaccagctgttcagaaccttctgatttttacatttactgaataagatttgagtaatgaaagtctgtagtcttaaaactctaaaacagttgtactgcttccaagcagcagtatttatagtaacgtaagctattaatgctaactcttgcatgtcaagaaacattagtcttaggaattcttcaaaaaatggcatcccaatgaaaataaatttgatgactatattttcatgaaaaaaaaaaaaaaaa

SEQ ID NO: 440 - DNA, 5795 bp, Human
gagcagcggcagcagcagcggaccccggcggcggcggcggcgcgcggtcccagccaggcggccccggtgtcccggccccggtggatgcacggctggggaggagcccatgggccggagctgaggctgcccggggcggcggggcgcggggcagggggcgcggtcgaggcccggaggcggcggcgcaggaggaagcggaggaggtcgggcgctcggggcccgggaggcgggccgcgcagcgccgcagccccgggctcgccatgctcctggcctcggccgtggtggtctgggaatggctgaacgagcacggccgctggcgtccctacagcccagcggtgagccaccacatcgaggcggtggtccgcgccggcccccgcgcggggggcagcgtggtgctgggccaggtggacagccgtctcgcgccctacatcatcgacctgcagtccatgaaccagttccgccaagacacgggaactctccgcccagttcgccgcaactactacgacccctcctcggcccctgggaagggcgtggtgtgggagtgggagaacgacaatggctcctggacgccctacgacatggaagtgggcatcaccatccagcatgcctatgagaagcagcacccctggatcgacctcacttccattggctttagctacgtaattgacttcaacaccatgggccagatcaaccgtcagacccagcgccaacgccgcgtccgccggcgcctcgacctcatctaccccatggtcacagggaccttgcctaaggctcagtcctggccagtcagccctgggccagccacctcgccccccatgtccccctgctcctgtccccagtgtgtcttggtgatgagtgttaaggcagccgtggtcaatggcagcactgggcccctacagctgccagtgacccgcaagaacatgccgcctcctggagtggtcaagctacccccactgccaggctctggggccaagccactggacagcacaggcaccattcgaggcccactgaagaccgccccatcgcaggtgatccggagacaagcctccagcatgcccactgggacaaccatgggctctcctgccagtcccccaggacccaacagcaagaccggaagggtggccctggccaccttgaatcgtaccaacctgcagcgactggccattgcccagtcccgggtgctgatcgcctctggggtccccacagtcccagtgaagaacctaaatgggtccagtcctgtcaaccctgccttggcaggaatcactgggatcctcatgagtgcagcggggctgcctgtgtgtctcaccaggccaccaaagctggtcctacacccaccccccgtcagcaagagtgaaataaaatccatcccaggggtttccaacacaagccgcaagaccaccaaaaaacaagccaagaaaggtaaaaccccagaggaagtgctaaaaaaatatctacagaaagtccggcacccaccagatgaggactgcaccatctgtatggaacgcctcacggccccctcaggctacaagggcccgcagcctacggtaaaacctgacctggtagggaagctgtccagatgcggccacgtctaccacatctactgcttggttgccatgtacaacaatgggaacaaggatggaagtttgcagtgtccaacctgcaagaccatttatggggtgaagacaggcacccaacctccagggaagatggagtaccacctcatcccccactccttgcctggccacccagactgcaaaaccatccggatcatctacagcatcccccccggcattcagggaccggaacacccgaatcctgggaagagtttcagcgcccgaggcttcccacgacactgttaccttccggacagcgagaaagggagaaaagttctgaagctgctgctcgtggcctgggatcgccgcctcatttttgccattggcacctccagcaccacaggcgagtcagacaccgtcatctggaatgaggtccaccacaagacagagtttggctctaatctcactggccatggctacccagatgccaattacctggataatgtgctggctgaactggctgcccagggcatctctgaggacagcactgcccaggagaaggactgaggccagaaaagctttgaggtgggaggggccatggagactgcaggacaggaagtgaggagagtgagtcaatgtagaagaagttggtgtcctgccctcccaactttctatcctcccctcctgccctgtgtccatccctcatccctcccaaccacagtgggagccagactgaatatagcgacatcattcataaatctcatccaacacaaagggagatgggatgagggccatcctgggtctgttcccatggagtttttggtgctgggtaggcaggaatcccctccctaccccacctcccaagtaggggcatggtcagcacacctagggtatgggcagtgcttaggcactccatatcctggctttgggaagccggggtttcttgcctcagccggcttcttgctacttccactctgctttgagactggagtttctgctattctccctctgctggaggcagggagctctcactgtgcaaggttggggggtgggcaaaggggtgaatcactaaactgctgtgacatcagaaactgatgccttggtgtagagcaaggaagcacttcttcccaagagggtcggagaaggaaaagcctctgggagcacattctgctgtcatcacagtccttggcttctctgggccctcctctcctcctcacagctctcacctgtccaaagaggcatctggttctctcatgtggatggatggactctggggttcctctttggagtggcatcccatgatgctgtttctagaccctctctgatcaaaccagagcctgcatcccactgagcatctgaactgtcctcagggagaggagcccacagccttcttcccaactcattctagaccagctcaaagattccatgagtttcatcgagtcactgtgagtggagcccatgctgggctctgtgccctctgtgtctgtgcatgcgcgtgtgtgtgtgggcgtgtgtgcattgctgggccagcttgaagggaaggcccgtcatgtccctgcactctgttttgcaagatgccaaaccccagttctgatggggctccaacagccaggctgtggtcctttgacgttcctcacctgttgccaacctatcccgtagtgaactgaaaccccaatgaagacagaactgtgcctggggagatgcaatgaggtgagggctgaactcatccttttatatttcttttcaagattggatcagagctcatctccatccagtcttgtttctatgaaggcttcaatctgtttccatgcaaatttgctaatcagagcccagagctgctgggtccctcatctccctcatctattatagattgacttacagcagggagagaatctctttagctcattcctaatggagttgggatcacaatatggtctggtccaatctgcatcttgttgtgtcccaagaccctatctcctccccaacattcttattgcctttggctcccagtaaggaacgaattgggggccagggaggagaacaggggggatcaagaagggaaacccaattccccctttgaaagtgggttctttgaactatgtgtttgggggaagttcctctggatactaatttgaatttatatacctcatgttttgggggtttgacgtatatatatatatatatatatgcatatatatttcataatatttggaaggtttttgatgctagaaaaatggaaacaagagaaccttcaaaaatggtacttagatgggaactggaggccaatctttcataaagccagccccatagctgcttgctgttaggcctccagccattttgacattggggtggatagtcgattcacctgcctgtcagtcgattcacctgcctgtcacccagttctgtggatgtgctggtgctgagcctttgctctctttccaaatggttacagggatgttgatcagctccaccagagggagctctgatgggaggaattgctctgccatccttgtccctgtgtctcctgtcggcaggcagccattgtatctcaccagcagaccaggagactggtcccaaggttactgcaccacagggcaatttcctgccatagttaggaaggaaacacctgaactaaatggaagagacatccctgcggtgtttaatatcacacccatgccctttgtcaggttaccatgtacagagattacttggagagcctcatgccgtctctaccttcgcacactggtcaagtatctgctgagcttcttggccgcaaggatgcagaaataggctgagggtccatgggaagaaagacacaatgaggcagtaggaggtggggaagaaaagaagacagactttcaaaatggaattaggcactggggagagatcagtttccccacatcagggagaagaaggtataggtggggaagggggtggccaggagcagaaggaagaagactcaagatggaaagggagccgctgtgcctgtggcaataccacttggagaggtcgacttcataccttcaagccttttcccctgggcttttgattgtgtctgtgccccctttcttgtcctctctgcagatgcccagtaggggctacctcatcctcgtgctgttcttgtgtggctttctgggcagtagggatcttgaatttcctttctaacactgtgcccggcaaggcggggagcattcctctgccctttgtcttgtgccaacctggaaaggtgcagtctagatttcagtgagaaccctgccagctgagccctgtgcatctactaccttgacacagagtgttttcccactagaagctctgctctgctctcctggcccaagtaggggattccatgccttccctttcatggtcttagcaccagcagcctagtttctcccttccagagtctccagggatgacaaattggattggagacaaacctcgtcagatgctcatcccctaaaaggttaattgtgtatttgtggctgcgtgtgcctttgtgttttcattctcttcccatttttgtacattttggtcttctctgtggttttatacttggtcaaaagtactcgtcttggtattgcactgttgtgtgcatgagaaaactgggggaaggctcactggtacaagaaaggacccctgacccctttccttctctgtggtccccggcattagattgggggttctgggagaggcaggtgaatgtcctaagtgaattgttctgtttgtaactggaatgtttttgaagtctttggtgttgctccgtgaaaggacatcgccacctggtgctcatgaggtgtctttgcagaacaataaatggcaaatgaacaaccacaaaattgttactcttgttggccttctgctgtttgtagattagtgcacctatctgtgagggatttgggttacctccctgagtctgtaagcaaccacaagccctgccactgggtgggggaagtccctccccaaccacttaaaaacaaattttccacatattacccacccacacatttgacctggctagactttgtttgcctaaaggaacagaccacattgctgggaaaatgagtaagtgaacgtgtgggagaaaaacacttttagaatcacgaatattcacttttaaaggtctctttgcctggctgcaatatagtgtgtgtttaaattatttacaggctgttgtttctcaaataaatgtttaatattaatcattcccaaactgacaagaacacaaaaataaaatgcaaatacagagcc

SEQ ID NO: 441 - DNA, 2517 bp, Human
gtgcgctgaacgccccatatccgggttcccgccgcctccaccgccaccgcctcagccgcctcgcacatttagtcttgccgggagtggtgtgattcccgaccaagatggcggccgtggggcgagtcggctccttcggttcttctccgccgggattatcctcgacttacactggcggccccttgggcaacgagatagcgtcgggcaacggtggcgccgcggcaggcgacgacgaggacgggcagaacctttggtcctgcatcctcagcgaggtctccacccgctcgcgctccaagctccctgcggggaagaacgtgctactgctgggtgaagatggagctggaaaaacaagcttaataagaaaaattcagggaatagaggagtataagaaaggaagaggattggaatatttgtacttaaatgtgcatgatgaagacagggatgatcaaacaagatgtaatgtttggatcttagatggagacctatatcacaaaggcctccttaaattttcactggatgccgtatctctgaaggatactctagttatgctggttgttgacatgtcaaagccttggactgctttggattctttacagaaatgggcaagtgttgttagagaacatgttgacaaactgaaaatccctcctgaagaaatgaaacaaatggaacaaaagttgattagagacttccaagaatatgtagagccaggagaagacttcccggcttctccccagagaagaaatactgcgtcacaagaagacaaagatgacagtgtagttttacctctgggtgcggatacacttacacataacttgggcattccagtactagtagtttgcacaaagtgtgatgccattagtgtattggagaaagaacatgactacagagatgaacattttgattttattcagtcacatatccggaagttttgtttacagtatggtgcagcacttatttacacttcagtaaaagaaaacaaaaatatagacttagtatataaatacatcgttcagaaactatatggatttccctataagattcctgctgttgttgtggaaaaggatgcagtatttattccagcagggtgggataatgataagaaaataggaatattacatgaaaattttcaaacattaaaagcagaagataattttgaagacatcataactaaaccacctgttcgaaagtttgtacatgagaaggaaattatggcagaagatgatcaggtgtttcttatgaagctacagtcccttttagcaaagcaaccaccaactgcagctggaaggcctgtggatgcctcaccaagagtcccaggaggctccccacgaacaccaaatagatctgtatcatctaatgttgccagcgtgtcacccattcctgctgggtcaaaaaaaattgatccaaacatgaaagctggagctacaagtgaaggcgttctggcaaatttcttcaacagtttgttgagtaaaaagactggctctccaggaggccctggtgtgagtggtggtagccctgcaggtggggctggaggtggaagcagtggtttaccaccatccaccaaaaagtcaggccagaagcctgtcttagatgttcatgcagaactagacagaattacacgaaaaccagttacagtttctcccacaacacctacatctcctacggaaggagaagcttcttgaagataccaaataaagccatttattctgttttctgggataatgtaaacatgcctctgccttttccttcaaaagtggaattagaaagctggagtgcttcttcagatggactaaatttatgtcgtgtgtgtgtgtgtgtgtgtgtgtggttacccattttttagaaggagccgtacagaagaaaaattattctacattatgtaggattgctgtttgcattgccattttgcataagaaagtaatttttgattttgaaaatctcaaaacttttagatctgaaatacagccatgtgatcgatcatattctaaaggctatttaaaacatgtaaaaggatttggggaacggcagaaaacatgcagtttgggcatttgactgacttggaagtctaagcttattttagttataactattaaaatcatttttaaaaatttgttagttttgctgacagagaaaaatcgtcagttgtcagattttgcacaccacaataaatgtaccaccacacacggaatatgctaagaaaactatcagatagcgtttgatacactagtcattgtctcaatcactgatcctgtaagttgtcatcaaaatatgatttagaaatattggccaaggtgttgctttaactgaggagaaaagaaagcacactgcctaaatgtgtaaaagaaaaatgcagaggttattaaaatgtaaagaagtaacaatctttggatttgtctatacatatatatatatatatatggctttgccttaatatacccccttttttgtttgtgactttcaactgtaatcagttaataaagtatttattctctgcattcaggttcaaataaaaaaaaaaaaaaa

SEQ ID NO: 442 - DNA, 3406 bp, Human
gagtattgcctttggcccccacccccacgggtccccgcgctccgtcttccttctgactgggggactccgcgggacggcgttcccggcgcgcactgtaccccttgccgccccttccccttcatgttggacctgacctcccgcggacaagtggggacgtcccggaggatggccgaggcggcgtgtagcgcacactttctggaaaccacccctactcctaatcccccgactacagaagaggagaaaacggaatctaatcaggaggttgctaacccagaacactatattaaacatcccctacagaacagatgggcactctggttttttaaaaatgataaaagcaaaacttggcaagcaaacctgcggctgatctccaagtttgatactgttgaagacttttgggctctgtacaaccatatccagttgtctagtaatttaatgcctggctgtgactactcactttttaaggatggtattgagcctatgtgggaagatgagaaaaacaaacggggaggacgatggctaattacattgaacaaacagcagagacgaagtgacctcgatcgcttttggctagagacacttctgtgccttattggagaatcttttgatgactacagtgatgatgtatgtggcgctgttgttaatgttagagctaaaggtgataagatagcaatatggactactgaatgtgaaaacagagaagctgttacacatatagggagggtatacaaggaaaggttaggacttcctccaaagatagtgattggttatcagtcccacgcagacacagctactaagagcggctccaccactaaaaataggtttgttgtttaagaagacaccttctgagtattctcataggagactgcgtcaagcaatcgagatttgggagctgaaccaaagcctcttcaaaaagcagagtggactgcatttaaatttgatttccatcttaatgttactcagatataagagaagtctcattcgcctttgtcttgtacttctgtgttcatttttttttttttttttggctagagtttccactatcccaatcaaagaattacagtacacatccccagaatccataaatgtgttcctggcccactctgtaatagttcagtagaattaccattaattacatacagattttacctatccacaatagtcagaaaacaacttggcatttctatactttacaggaaaaaaaattctgttgttccattttatgcagaagcatattttgctggtttgaaagattatgatgcatacagttttctagcaattttctttgtttctttttacagcattgtctttgctgtactcttgctgatggctgctagattttaatttatttgtttccctacttgataatattagtgattctgatttcagtttttcatttgttttgcttttgtttttttcctcatgtaacattggtgaaggatccaggaatatgacacaaaggtggaataaacattaattttgtgcattctttggtaattttttttgttttttgtaactacaaagctttgctacaaatttatgcatttcattcaaatcagtgatctatgtttgtgtgatttcctaaacataattgtggattataaaaaatgtaacatcataattacattcctaactagaattagtatgtctgtttttgtatctttatgctgtattttaacactttgtattacttaggttattttgctttggttaaaaatggctcaagtagaaaagcagtcccattcatattaagacagtgtacaaaactgtaaataaaatgtgtacagtgaattgtcttttagacaactagatttgtccttttatttctccatctttatagaaggaatttgtacttcttattgcaaggcagtctctatattatgtcttcttttgtggtgtcttccatgtgaacagcataagtttggagcactagtttgattattatgtttattacaatttttaataaattgaataggtagtatcatatatatggaattaaattgatgtggctatctttgtttttttataaagtaaggcacagtcattcagtcttaggtaaataatgtactctcttaatatgttaatactcatgagaattgggatctgatgcatcaccatttgattggtagcaacagtggttgtaaaacttggttgctgaattgagttgtttctatgttaagtgtcaaaatgatagtgtagggaaagtacaggtggtggggacatatgcattaagaatcttgttagtgttgcaatctaaatagaatggaataaacaggtgttaagacatatttatagtggtaaattgttgtagtatggtattctgtaaacttgaaaacttgatctactctttgtaggtatcatttgaaagcaaacttgaaaatgttttgtacatagtacatacttgtatagtcctgtgagatgaagtatggctatcagaccaaaggataagccaaactgtaggtagcagaatggaaattattattttgagaggaaaatttgtctttgaatggtgattatgacttaatcattttaaaactgataaacttgacaaaaaccctgtatgaaataaacatgaaattaatagcactgatttcattgtaaaattttaaagcagtttaaagggtaccacaggttatcacagtactctcaatgccacaaacacctcttgttcagtattctagaaatactgaatcagaattctgtgtttattataatctcagcatactgtacataatatctgctagttaaacttgggtaattggttaaggtgacttactgtctatgtcaatatgtatagttttgagtacttcaagagtttacttaaaagtgatgatgttactggtatgttggcagtgggtgggactgaagtagtgtatctattataaattgatctattttcttaattctaagatgaagtccaattttaagcatcagcttttaggtgcaaaggaggaattaacacattaaatgtatacagttctaaatttttgaaataactgatgtgtagcatttgattattggtattaccattttagaatcatgatgttattttaaacctttttcctggggacaagaaaggataataaattacgctgaatcacttttggcagttgccacttaaatagtacagtgacttgcaacttttataactttatcagcatcttctctaaatacaaaattaggctatatgttattttccaacttactgttttctctctgtttagcaggatattataaatagattaaatagatatattttctttttttttttttttttttgagacggagtctcgctttgtctcccaggctggagtgcagtggcgtgatctcccagtagctgggactacaagcacctgccaccatgcccggctaattttttttgtatttttagtagagacggggtttc

SEQ ID NO: 443 - DNA, 3265 bp, Human
ggctccgcgtccggcgcctgtttgtgctgcggcgctgtggcaccggacggccctgccaccccacccccgggagccgagagcggccccgggagagtccgagggcccgggggggtctggagactgcggccccgggcccacagcgccccctccaggccccttccccgcgcccgacagcgccccctcggggtggtggtacggcgcccttcgcgcgcgccccggggtgcttccccttcccctctccccggccgtggcccccgcggcttagacgcctcctccgccgccgccgctcggagcaacccgggggccggatggacggggccgcggggcccggtgacggccctgctcgggaggccctccagtctctgagccagcggcttcgggtgcaggagcaggagatggaactggtaaaggcagccctggcagaagcccttcgcctgctgcggctgcaggtgcccccttcctccctgcagggctctggcacaccagctcctccgggggacagtcttgcagcccccccaggactgccacccacgtgcaccccttccttggtgagccgaggcacccagacggagacagaggtggagctcaagtcatcccctggaccccctggcctgagcaatggacccccagcccctcagggggccagcgaagagcctagcgggacccaatctgaaggagggggcagcagcagcagtggtgctggctcccctggccccccggggatcctcaggcccttgcagcccccacagcgtgctgacacgccgcgaagaaattcttcctcctcctcatccccctcagagcggcctcggcagaagctctccaggaaggcaatctcctccgccaacctgttagtgcggtccgggagcacagagagccgtgggggaaaagaccccctctccagccctgggggccctggatctcggaggagcaattacaatttggaaggcatctcagtgaagatgttccttcgagggcgccccattaccatgtacatcccgtctggcatccgcagccttgaggagctgccgagtggcccaccgccagagaccctcagccttgactgggtttatgggtacaggggtcgtgactcccgctctaatctgtttgtgttgcgctctggggaggtggtctactttatcgcctgtgtggtggtgctgtaccggcctggaggaggcccagggggtcctggaggtggcggccagagacattaccgggggcacacagactgcgttcgatgccttgctgttcaccctgatggtgttcgggtagcctcgggacagacagctggagtggataaggatggaaagcccctgcagcctgtggttcacatctgggactcagagacgctgttgaaactgcaggagattggactgggggccttcgagcggggtgttggggccctggccttttcagctgcggatcagggtgcctttctttgtgtggtggatgattccaatgagcacatgctgtcggtgtgggactgcagccggggaatgaagctggctgagatcaagagtacaaatgactcagtcctggccgttggcttcaaccctcgtgacagcagctgcatcgtcaccagtgggaaatctcacgtccacttctggaattggagtggtggagtaggggttcctgggaatgggacccttacccggaaacagggtgtctttgggaaatacaagaaacccaagtttatcccttgctttgtgttccttccggatggagacattctcactggagactcagaggggaacattctcacctgggggcggagcccttcagattccaagaccccaggcaggggtggcgccaaagagacctatgggattgtggcccaggctcacgctcatgaaggttctatcttcgccttgtgtctccggagggacgggacagtgctgagtggtggcgggcgggaccgccggctggtacagtgggggcccgggttggtggccctccaggaggctgagattcccgagcacttcggggccgtgcgagccattgctgaagggcttggctctgagctgctggtgggaaccacgaagaatgcattgctgaggggagacctggcccagggcttctcccctgtaatccagggccacactgatgagctctgggggctctgcacacacccctcccagaaccgcttcctcacctgcggccacgaccggcagctctgcctgtgggatggggagagccatgcactggcctggagcatcgacctcaaggagactggtctctgtgctgacttccacccgagtggggcagttgtggccgtaggactgaacacggggaggtggttggttttggacacagagaccagagagatcgtgtctgatgtcattgatggcaatgagcagctctcagtggtccggtacagcccagatgggttgtacctggccattggttcccatgacaacgtgatctacatctatagtgtttccagtgatggtgccaaatccagccgctttggccgctgtatgggtcactccagcttcatcactcatcttgactggtccaaggatgggaatttcatcatgtccaattctggggactatgagattctttactgggacgtggctggaggctgcaagcagctgaagaatcgctatgagagccgagaccgggaatgggctacctacacctgtgtgctgggctttcacgtctacggcgtctggccggacggctccgatgggaccgacatcaactccctgtgccgctcccacaacgagcgcgtggtggcggtggccgacgacttctgcaaagtgcatctcttccagtacccgtgcgctcgtgccaaggcgccgagccgcatgtacgggggccacggcagccacgtgaccagcgtccgattcacgcacgacgactcgcacctcgtctcgctgggcggcaaggacgccagcatcttccagtggcgagtgctgggcgctgggggcgcggggccggcgcccgccacgccctctcgaaccccctccctgtcccccgcctcctccctcgacgtttgatcgctgcctggcgggaccgactggcccggcggcgtggccccgccccgccctgcccttccctggcccaatcccccacgactaggggccgactctttcctggactgacttcgagacattcccgatcgcgcattttcctggagggcgcgaacggcgcccctgcacacactgtttagacccgctggctgagccgggcagccccagcctaggccttgactcccgctgcctgctgaggggcaataaaccagaaccaaagtcgaaaaaaaaaa

SEQ ID NO: 444 - DNA, 13172 bp, Human
gggttcctcgcggcgatcccgactctcctcccgcggctgcagcagctgccggttgcacacggcctcggcggcggcgcggcgagcgcgggcctgtggagcggcggccgggcgcgcggccccggcgggcacccctcagagggcggccgaggaagctccgggaggaggagcaggaccacgaggaggtgggaggcggcggccgcctggggaccagctccgcgcctcggcctctccgccccctccccagcctttctctcgccctcttctcccacactcccggccggcgcctcggctttgtgcgaggagatggtgtagccccctggccgccgaaggaggagccggacacttgtctcccgtctccgagctgctccccacccctggaggagagacccccccctcggctcggcgccttctgcgtctcccggctggtggggaagcctctgcgccgccggcaccatgagtgaacagagtatctgtcaggcaagagctgctgtgatggtttatgatgatgccaataagaagtgggtgccagctggtggctcaactggattcagcagagttcatatctatcaccatacaggcaacaacacattcagagtggtgggcaggaagattcaggaccatcaggtcgtgataaactgtgccattcctaaagggttgaagtacaatcaagctacacagaccttccaccagtggcgagatgctagacaggtgtatggtctcaactttggcagcaaagaggatgccaatgtcttcgcaagtgccatgatgcatgccttagaagtgttaaattcacaggaaacagggccaacattgcctagacaaaactcacaactacctgctcaagttcaaaatggcccatcccaagaagaattggaaattcaaagaagacaactacaagaacagcaacggcaaaaggagctggagcgggaaaggctggagcgagaaagaatggaaagagaaaggttggagagagagaggttagaaagggaaaggctggagagggagcgactggaacaagaacagctggagagagagagacaagaacgggaacggcaggaacgcctggagcggcaggaacgcctggagcggcaggaacgcctggagcggcaggaacgcctggatcgggagaggcaagaaagacaagaacgagagaggctggagagactggaacgggagaggcaagaaagggagcgacaagagcagttagaaagggaacagctggaatgggagagagagcgcagaatatcaagtgctgctgcccctgcctctgttgagactcctctaaactctgtgctgggagactcttctgcttctgagccaggcttgcaggcagcctctcagccggccgagactccatcccaacagggcattgtcttgggaccacttgcacctccacctcctccaccactcccaccagggcctgcacaggcttcagtagccctccctcctcccccagggccccctccacctcctccactcccatccaccgggcctccaccgccccctcctccccctcctctccctaatcaagtaccccctcctcctccaccacctcctgccccacccctccctgcatctggattctttttggcatccatgtcagaagacaatcgccctttaactggacttgcagctgcaattgccggagcaaaacttaggaaagtgtcacggatggaggatacctctttcccaagtggagggaatgctattggtgtgaactccgcctcatctaaaacagatacaggccgtggaaatggaccccttcctttagggggtagtggtttaatggaagaaatgagtgccctgctggccaggaggagaagaattgctgaaaagggatcaacaatagaaacagaacaaaaagaggacaaaggtgaagattcagagcctgtaacttctaaggcctcttcaacaagtacacctgaaccaacaagaaaaccttgggaaagaacaaatacaatgaatggcagcaagtcacctgttatctccagacgggattctccaaggaaaaatcagattgtttttgacaacaggtcctatgattcattacacagaccaaaatccacacccttatcacagcccagtgccaatggagtccagacggaaggacttgactatgacaggctgaagcaggacattttagatgaaatgagaaaagaattaacaaagctaaaagaagagctcattgatgcaatcaggcaggaactgagcaagtcaaatactgcatagaggaacagactaaggagagataggactttaatctggaggaaaaatatcctacaaacaacaactgttcacaacagcaaacccctacatttatgagctgtaagaagaaaatggagacaaacagaaggagggaaaaaccaacctactctgaaagccttcagacattatgactctggtgataagctctttccctctccgtttgctgcttttttctggcctttacaacagaatggaagagaatcatttaagagttcctgtaacagttatgcagaaaatactaaaacccatcaggcaagatcaccacgcattgaaatattttcatatcaagataaagtcgcacattttccacaatacattgctaaaataaagaggagaaaggcttaggaagtttttttgcagagagtgctggtaaagaattgagcaagtttgctattgtattgtaatgtttctctcaggtttgttcttcctatcatgtttgatattccatgaataattgagatcagccctatgtaagttaagatcataatatgtggaacaaatggaattgtaagtgctttcaaagggtaatatttataagaaagtgtccgaaaaatgtttcttcagcttgagaaattttagaatgataggaagtttctcgagttagccttcatgcaattttgtagattaaaacataaaatttgtccagaacttaaagatttagatgccttcctaaattgttacaatgctttaccaaatctatgacttctacataacacaaaccagtggtcaaatgtaaacactatattgtagatttactgtaggttttcaaccttttttagatttatgcatgtggacatttttataatgtaattacaatcaccacaaggttagcttttttaattgcagacagtaatgcatgtcacactaatatgtagtggccttttcaaggcctagtcccagggaaaacattttgtagagtataggggagtgggaggaaggggaggaataattttttatttaaagttgatttctgcactatctttttctcagttacctgcatgaataaataatgagaaatattttgtgactttaattggtaaatatgttacaaaaccaagtacttaatcttttacatcatgtcttcagctatttgtattttaaccagtaatttcaatggtctgaaacatgattctgagcttcacataatatcttaactgtggaactcaaaagtttgatcactgaatttggcagttattattacctaggtacccccgctgttacacaggtgtttagatacgtgttcctgaatgaagctgcttttgaattttgttatgttgaaatgcaagaaataacaatgatggcagcaattaaggtcacagaaatcattaggtaaaggaaaaccaatgaggagttctgcagttttcttttaataagtaaagtgagacttgggtggtgggaagaaggaaggtgggaagaaggaattagacactctgcctgccactctgcgtgtgtgtgctctcgcgcacgtgctgtctatatggaagccactcccttttctttcctttgaaactggtaaggttaaaataggggagaaatcctacatgttggaatgatagctttttggaaaatttaagaaactctccaggctctccatcttgatttatgcttgagttgttatgtgccatatttgctttgaactctgattatcagaagttttactaaaactttgaaataattcactttcatctgctttctagattttgtacatctcagtccataaagcaaagcttgttgatagtgtagttttctaaacgctgcaaatttgcagcctttaccactacaaagaagtttggatgagggattttttttttctttgtcaaaatagttcctgtttctgtagaaatttcatttttagattaaactgtgatggatgagctatcataattcaagtatacatttcttttttctatcagatattcattgtcatgcagtagtagtaaaaacatcaaagatgcagcaagcttattaagtattattttctaaaagaaataggaggcattttcatctttattattgtacttttggttatgcaaacactttgataatataaacagttatgtcccctataaatctggtcagcaacctcttttgattttgttgggtaagttaaatagtctgtagtaggtagagtactgggtacaagtggtccaaactaagataagagactaaaataaaatgctaaatcttaaaagaaactgggtttatgcactaaacgttttgtgccttggtctaatattaacatgatgtatgtgtaaactgacaaaaaaaaaaaaaaaaaaaaaccagtgttgaatcatgctatatttcccatcatcccagattgctaaatgttctttccaagaagtctgaatgaattattatatacatttgctatcatacatgacagttgtgtcattattagagatttcagtaattaaaatgggaaacagaagcctaagttatttaccttatcaaaaccacgttccttggaaccacattattatgatggtttttgtgctcttgtacgttggatgtcttaagctgagtacagtttaggggatcctttctaatgacaggaaggcactgctttcctcaacactgtgatctgacctgtgacaagtctgtactatccactatgtaaatggctcacaagtcaattgcaaacaaactgaatgtacaaatcttagtgctggtgctgaaatctcttcagaatagtcatcatgatttaaaagtttgtttaaaaatttgcaagcatcaagtgtcaatcaaaactgaagatgaaacactaatgaatgttgaattctcatgcttttaggtgtacttcctttttagaattttcagttttctgctatttttaccgtaactatttcgtttaaatttgtttcatttaagtttcctacacgctaacttcgtttgtgcgattgaaataaaattgcagtatatatatgttgcttgtttgtgacacttagataatcttctgaaataatttgttttaaagtaagttatattggatgtgaaaaacaccttttaaagtccaagactttactacttaaaagtttacatgtcacgtcactattctttacagatttcatagaagtcgtgaatactaagtaatgtatacaaaagaaatatgtgatgatgtgtctactttttgtttgaaataactgttgggtgttccctcttcttattttctctctgcccaccttgacacagtaacttcctcttatagtcaagatgatgattaagtgtttaatttttattccattttgttctgcaacacgttcaggtacttaaaactcattcatgcagttagaattatcctttatgtagtttgcatggtaaaggacattgtgtggtaaagggcattattgagtaatgaattttaagtatagcaaaatatgtatagtgtttatacatgatgctgatttcttaaaacctacatataagcagtagtactttttctctattataaagtattaattttgagttccattttataattctgatgtcttcattagaaatacaaaaatacaatccttgtattttttctttgaccagacccaaattttccccttcccccctccattctcctctccacttctcgtggaccgcgtgttcccaatattcattaacatttgcagccattacagagttacagttgtaaaattttcagctgtttttttttttttttttttgctctagcctgtctcatgttcttgcttctcttcatatgtaagtcagtatttttgtctacaaattaaaagtcacttgtcattcaaaaatgagttaagtaacatgataatcttttaaatttacctagctacaacttttatgtctcttgtaaatttatatatactttcagtgccattgtgaagaattggccttttaattctaagtagtattaccctatgaagcacagtgtgcaaaggtatgctacaaggtctctttaattcctgtgtggccattataattttataacaccattaccctttaaattctaccgattataagcagcgtaaaagtaactatataaagcaaacatcgcaaaggaactctgcaggagctcttaattcctttatgtagctatcataaaattcactttcctgaagacatttactctcattcacttccaaactccaaacctttttctggtagcaccacttttgtttttaatagaaagatgagttcatatctgtacatctctccaaagctctaaggaatgagaaaaggatcctagtatattgaaattactgatgtttaatacctctgccttttcactaaaagccatttaatatttttaaagtcaaaacttgacatacaggtatttataaggaatctccatgactctgaaggaatgaaattgatgtaggtagctttggctatgtaaagacatagtagaggacaattacttaaagaagagttttcttttgaggatttgtagatttgactaagcagctgaagtcagtaacccctcaagaaagtccgtttatagaagccaagaactgttggaggtctgtgatgcaggtttttctgttcccaacatcaaaagctgtggattatttggtgtgttcccctttatgttatctctcgataatttttgagacatcaagattttttaaaatatcaatactggaaagatgaaaccttcaaattaaaacctaaaattgattagaaagaaaagtaaaatattaatgcagtaaatttaggatggttacagatactcaccatcaacataaataaatggagttctaggataaattatttgtggaatactaatggtcaagtcacataagagtaaaatcttttggtgaggagacacatttgacaactgctaaagaattaactaaatttgtctttctaaatagttttctttataaagtaacagaaacattgtaaaaggataaatgactgtcataatgacttaggatgttgtaagaatgtctgccacatttattggttatttctgttgaaatctgaaggaatcgatacatctgaaaattgagaaagggaaataggactgtccccgttacagatactctgtgatgcacacaaccttctaaacggaagtgttagtatcatttaaagcacatagtaggccttgagtatttgcagattaacatgcagaaaaaatcaaagatgaagccccaattaagtgtttgaaccaaagaatcacagtcactgagctgcacccccgttctgtgaagcatgttaaatactcataaagagcagagagcagggcccgtagacgcttctggtgtaggacacaggaattctaggcagagggagaaaattaggggccccagttggtggctgagagtaaaaagaatataccatttgagtagtgctgttctttttcctcagtttttaaagacatataattcctagtagttaggacatctaaatagctcggtaaactggtcagaggcgggaggattgcttgaggccagaagttttgagatcagcctgggtaacagggagactcatttctacaaaaaaatttaaaaatttaggccaggcatggtggtgcacacctgtaatcccagctactcaggagactgaagcgggaggatcacctgagcccagggaggacgcggctgcagtgagccgttatcatgccactgtactccagcctgggtgacagagcgagaacctgtctctaaaaaaaaaaaaaaaaaattctaagagaatatagcttttcatagaaattattagaaaagcttacatatttcattagagagcccagtttgttagactacatttattccgtaaaagttctatatacaaatgacaacccatagtttatcatgtaaatctgatttaactgttcccttcaattccaagaaagatttcttcagcagtagatgacaattctaaaagcataaagaaataactaataaaggagatggatgatgttataggttggtttggttgggttttagtaaatagttattcttctaagaaggcttagaaaatcgagaattgaatagttggtactttgaattccataggaaaaagcactcagaagaaaaagtctacattggctagtgtttagattgagagttaattttcccatcaagtccaaaagtttccatccaagtctatagaaactgagagaaaaggttcttggcttacacttaaaatacacattgttgcaaccatataagagagatacattacagaacgcttttaaaaatttggtctcttaagcgcctaacagtccatgctttagtcacatctgtgaaacctcttttctttttttctttttcttttatttttttttttaaagattaaaggcattttaaaaataaatgtttcatggccgggcatggtggctcacgcctgtaatcccagcactttgggaggctgaggtgggcagatcacctgaggtcaggagtttgagaccagcctggccaacatgatgaaaccccatctctactaaaaatacaaaaaaattggctgggcatagtggtgggcacctgtaatcccagctcttcgggaggctgagacagaagagtcgcttgaatccaggaggtggaggttgcagtgagctaagaccgcgccactgtactccagcctgggcgacagagcgagattccatctctaaataaataaatgtttttcaacgtgttttatgtgagaaataccagcttttcattattactaccagttgatctcaggtgtcacttggttggttctgctgaccgaggcactgggcattttaaatatggagtttccctccacccattgatcaagtctgaggtttgtccatccttggtggcaggctagcttaaccatggattcacaaaccccatttgattgtcgtaagtcataaggccaccccagtgccagtggttgggcatcacagtgagtctgaggtgatgaatttgagttagctgtaggctagttccgcaactcagcaatagcccatggatggttggtaaaagacgttgactttgccacttaaatttccaggagaagaatagcttatagtttatctgaggaaagtaattgggaaggcttagatattgagaagaaagccctgttaaaatctaggtagcatttcctttcttctttattactagagggatgggaggttcaggcctgagtcaggactttacaatttggtgtccttcccagaggtactttgggcttgatcattttaagtttcaattgcaaaaaaaaatttttgacggagtgttgctctgtcactcaggttggagtgcagtggtgcgatctcggctcactgcaacttcccccccctgggttcaaagggattttcctgcctcagcctcccaagtagctgggactacaggcgcgtgccaccatgcccgactaatttttgtatttttagtagagatggggtttcaccatgttgcccaggctggtcttgaactcctgagctcaggtgatctgcccgcctcggccttcaattgcagaagtttttgaagggagaatatttgatcctcacataaaatgtccttgtttctgaaagaaaacatggtaaaaattgttattgagtccatgtctttgccaccttgttggacttgatttccctttctctgtgttcctcccgccctcagtctctctcagtctgtccttttttgtgtgtggagttgtgggcaggtcattggactgggactgactttaccagttttcaggctgtggggctagtcagtcattctctctgagccttctacctctaaagttgagttctttttttaaattctttttgttttgtttttattttttccttgccactatacaagcaaggatagataaagctttttattattattgttattattattatttcgagacagtctcgctctgtcatccaggctggagtgcagtggtgtgatttcagctcactgcaacctctgcctcccgggttcaagcgattctcctacctcagcctccttagtagctgggactacaggcatgcgccaccacacccggctaatttttgtatttttagtagagacagggtttcaccgtattggccaggctggtctcgaactcctgacctcaggtgatccacccaccttggcctcccaaagtgttgggattacaggcataagcgaccgtgcccatccccgataaagttgagttctgaatttcctctttcactgtattctcggcagctactggttggtttattctttttttttaatcttttttggtttattcttcttttgatctttgaagagaaggagaaaaaagatctgagtttggctctcccatcttaagtgcagcttttagttgttttatagtcatagacgctattgcactggacagcatgcatcctggatgtaaacaatgcggaaaaatcaatggagtgaccatcttggggtcagtggtgttgcataaagcaccagtggtgtgctgttctgtgtcagtttcctctgcgccacgtgctttcacagtttgaattaccagcatctctgtggtggcttcagtacattctccattgtgcttcaacctggaagcacattctgccgttcagaaagactgattccaatcatgtaatgggaccacacgagatccatgctccaattatatgaatagcagaaggtccatttgactcttgtagttcaagagctgtttctaagtaaacagactttccagagctcgatgaagtgaagaagcccttctttcaattcctgggcagaattcagtggttttcatatcatctgaacctgctgtgctgctgtttattctatcactgtcagccttgaaaggaaaaaaggaataatcttaccctcctgcccttcttattttatatcttccatcttatccatctatatccatgtagtcattccttccgagttccctggttttaatccaaaagactctgtttaacagcaatgtcttggcagaccaggtgccgcttccgtgccatttgagggctctgagtctttgcttcgtcttaggaagataaagataatttggcagaaagtcagagatggaaatagcagtttgggatgataaaagatgggtcctgttttgctgacattcttttactttggttcttggtgcgtgtcctttgggattcatttcttgctagcatgaataggacatgcttttcgttaggtgcttttcttttttggagaacatgaagtgtttctaacaaaactgaatgagctagaaagaattctattttgagacatctgtagttgatgcaaagtatttctgtaatcctcaatgacagtacttacatatttgcatagaattttttttttaatttttgaggaaacctctctggagtctgtatttataggagcatcctgaaagtccctattatgtagctggtgggagcgagagagggacagccacactcgtgctgtgagcagagcacaacttcaggcagagtgaatgccttctgagttctcattggaagctttctgttgctcagcctctggcagatttcagaaccttctacttaagccaggtgtggtggtgcgtgctcctaggcacagcgactcggggggctgaggcagaaggatcacttgagcccaaagttggaggccagcctgggcaacatagcgaggcctgtctccttaaaaaataaataaataaataataaataaataaataaataaaaaccttgtccttgactattgtgctgtctgctgcccctttgtagggatggggttggggtcagaataagcatgtgcatgaatggcggaaagctttggtggtgtttgtttgtttgtttgttttttgagaggtgggggagtcagcagtgaacctttctggttaaagaacaacgtacataatttctattatgagatttagaaggttaaatacttttttttttcaggcctaccaagttgatagaccaaaagtatatagtagaacagcacagtagaaaaaatttaaaagtgaatttcttatggtccaaaaggatggatagtcacagtccataacctttcataatatatgctggaattggaatctcttgtcatcttgctttgctctgaattttagaactagaagtgtgcatgtatgtcaaaagattatgcagagctattttctttgctaacaatgtaaacatttgcaccccatgaatgggactttataatctggaagtgagcctaaggttgcgtatactgaagtcatgttttaaaagttaaggttgacttaaacatatacaaggctgtattttaattgtaactagaaatcatttactatgcatacagaacctcatgtatcttatcatggaatttgtgaattaatgggccttgccgaattcaagggtaagggaaactggtaacaacttgttttaaatcaacatactataagctcctgcttgcttgactcaagttgtttgaaaatctgaattaaacaggatctcattgtcaggaaacatcttctaagcttgacatctacgtttaagaagggaacgtggaagagaaggtgagacatgaaactaaaacagctgggagggtaggatcagactgcacctgatttttggaccaaagtttcatataggaataaataaaaaggaggaccacttgtgagccaacctaggaaggacttgccagaaagtagcagctcctgctgcaaaatacagtgccttcaaaatgattctctgtgtgaattgcatgcaatttcatgtaaccataaagtgtaacctgtatgtgcatgacatgtgtctagaatgtgtaaagttaggattcagcaggaaggggcctggccctgtcactgtggtggatcagtggacctgctgaagtcactggactcatgtgacttaggtttgcagcatcagacccctgtgtttgcattaagtggccacatcgttgaaatcggatcaatctctccctcagctttctttcctactttgcagctttgctggttttaactgcttcattcttctgcttcttggtatccttttttcttttgaaataaaaacatgaaatacttaattc

SEQ ID NO: 445 - DNA, 3617 bp, Human
aagtttccaagtggtcaacttgaccgatgctttggcaattgaaaaagggcagaaaggcgcgggctagtgggtggatggggacaaagatctaagtcaccttcttccagcgtgtgagcctgggaggagggtgggggtcctgaggagcaagaggtacgaggaaggaaaaggagagggcttctgggttagtttccacctcctgctttccaactcacggcgctttccttccggaaaggacgctggattcagggcgcgccagtacgcgcagtagcggcccgcgagtcggcaggtgggtagccccggcgcgggaggaaggggaagttaccttcccctcggaagagggcgctggctcccccatcctgcctttataataaggccaccggaggagaggaagcagccagctgccgtctgcgctttgcaaagcatgcagttaggggagcagctcttggtgagctcagtgaacctgcctggcgcgcacttctacccgctggagagtgcgcgaggcggcagcggcgggagcgctggccacctccccagcgcggccccctctcctcagaagttggacttagacaaagcgtccaagaagttttccggcagtctctcctgcgaggcggtgagcggggagcccgcagccgccagcgcaggggcccccgcggccatgcttagtgacaccgacgccggggacgcatttgccagcgctgcggcagtggccaagccggggcccccggacggccgcaagggctccccctgcggggaggaggagctgccctccgccgctgcagccgccgccgccgccgccgccgcggctgcggccactgcgcgctactccatggacagcctgagctccgagcggtactacctccagtcccccggtcctcaggggtcggagctggctgcgccctgctcactcttcccgtaccaggcggcggctggggcgccccacggacctgtgtacccggctcctaacggggcgcgctacccctacggctccatgctgccccccggcggcttccccgcggctgtgtgcccacccgggagggcgcagttcggcccaggagccggtgcgggcagtggcgcgggcggtagcagcggcgggggcggcggcccgggcacctatcagtacagccagggggctccgctctacgggccgtaccctggagccgcagcggcgggatcttgcggaggactggggggcctgggggttccaggttctggcttccgtgcccacgtctacctgtgcaaccggcctctgtggctcaaattccaccgccaccaaactgagatgatcattacgaaacagggcaggcgcatgtttcctttcttgagcttcaacataaacggactcaatcccactgcccactacaatgtgttcgtagaggtggtgctggcggaccccaaccactggcgcttccaggggggcaaatgggtgacctgtggcaaagccgacaataacatgcagggcaacaaaatgtatgttcacccagagtctcctaatactggttcccactggatgagacaggagatttcattcgggaaattaaaactcaccaataacaaaggcgcaaataacaacaacacccagatgatagtcttacaatccttacacaaataccaaccccgactgcatattgttgaagttacagaggatggcgtggaggacttgaatgagccctcaaagacccagacttttaccttctcagaaacgcaattcattgcagtgactgcctaccaaaacaccgatattactcaactaaagattgatcataacccctttgcaaaaggcttcagagacaactatgattcatcccatcagattgtccctggaggtcggtacggcgttcaatccttcttcccggagccctttgtcaacactttacctcaagcccgctattataatggcgagagaaccgtgccacagaccaacggcctcctttcaccccaacagagcgaagaggtggccaaccctccccagcggtggcttgtcacgcctgtccagcaacctgggaccaacaaactagacatcagttcctatgaatctgaatatacttctagcacattgctcccatatggcattaaatccttgccccttcagacatcccatgccctggggtattacccagacccaacctttcctgcaatggcagggtggggaggtcgaggttcttaccagaggaagatggcagctggactaccatggacctccagaacaagccccactgtgttctctgaagatcagctctccaaggagaaagtgaaagaggaaattggctcttcttggatagagacacccccttccatcaaatctctagattccaatgattcaggagtatacaccagtgcttgtaagcgaaggcggctgtctcctagcaactccagtaatgaaaattcaccctccataaagtgtgaggacattaatgctgaagagtatagtaaagacacctcaaaaggcatgggagggtattatgctttttacacaactccctaaagagttattttaacctcaaaaattagctaactttttgcagatggacttggtggtgttttttgttgtcttctttgcctaggttgccaaaaagatgtttgccttccaccttgatgcatcctgttttgtgcaattctctaaaagaaggtgccaaagctttttgattgctgcaggtaactgaaacaaacctagcatttttaaaaaataagattaatggaagactttaaggtattttaaaattcgaagggtatccaaggttctgtatttatttattggggagacactaacccttcaaagaagcaggctgtgaacattgggtgcccagtgctatcagatgagttaaaacctttgattctcatttctatttgtaaattcttaagcaaatagaagccgagtgttaaggtgttttgcttctgaaagagggctgtgccttccgtttcagaaggagacattttgctgttacattctgccaggggcaaaagatactaggcccaggagtcaagaaaagcttttgtgaaagtgatagtttcacctgactttgattccttaacccccggcttttggaacaagccatgtttgccctagtccaggattgcctcacttgagacttgctaggcctctgctgtgtgctggggtggccagtgggactcaggagagagcaagctaaggagtcaccaaaaaaaaaaaaaaaaaaaagggagaatttaaaagtgtacagttgtgtgtttagatacactatagaataatgtggtatatattgtacaaatagtctacataggtgtctgggataatgtaaaactggtgctttggctttgtaaagaatttgcaaatcacttaacagctgcaggggcaaggggagagtttcatcatccccatgatatttgggaatattctgtttacttcttagatagttaagaatgtattcagctactatgtactaacttgaaccgtgtttaaggaaaactcctatttcatcctcttcttgcgccatcccctctccctaacttggtaatgtgaagaaactaaaacctgataccacagctcctataggcattttagagatcttggatttttatgtacagtcttagtcatttttaataaatgtggttcagtaagggaacggaaaaaaaaaaaaaaa

SEQ ID NO: 446 - DNA, 1369 bp, Human
cacggcgcgggcgtcagctgactgttcggccgccaccgccgctgccgctgccgctgtcgctgtcgccgccgccgccgcccgccgccgccgccgccgccgccgccgctgccatggctcaatacaagggcgccgcgagcgaggccggccgcgccatgcacctgatgaagaagcgggagaagcagcgcgagcagatggagcagatgaagcagcgcatcgcggaggagaacatcatgaaatccaacattgacaagaagttctctgcgcactacgacgcggtggaggcagagctcaagtccagcaccgtgggtctcgtgaccctgaatgacatgaaggccaagcaggaggctctggtgaaggagcgggagaagcagctggccaagaaggagcagtccaaggagctgcagatgaagctggagaagcttcgagagaaggagcgtaagaaggaagccaagcggaagatctccagcctgtccttcaccctggaggaggaagaagagggaggcgaggaggaagaggaggcggccatgtatgaggaggagatggaaagggaagagatcaccacgaagaagagaaaactggggaagaacccagacgttgacacaagcttcttgcctgatcgagaccgtgaggaggaggagaatcggcttcgggaagagctgcggcaggagtgggaagccaagcaggagaagatcaagagtgaggagatcgagatcaccttcagctactgggatggctctgggcaccggcggacagtcaagatgagaaagggcaacaccatgcagcagttcctgcagaaggcgctcgagatccttcggaaagacttcagtgagctgaggtccgcaggggtggagcagctcatgtacatcaaggaggacttgatcatccctcaccatcacagcttctacgacttcatcgtcaccaaggcacgggggaagagtggaccactcttcaactttgatgttcatgacgatgtgcggttgctcagtgacgccactgtggagaaggatgagtcccatgcaggcaaggtggtgctgaggagctggtacgagaagaacaagcacatctttcccgccagccgctgggaaccctacgaccctgaaaagaagtgggacaagtacacgatccgctgagcatccaggaggctgcgcggccccggctcctcagctccctcagtgtgccccgtggtgtcaccgggactccaggcacccgctcccctgcgaccatgccaggcacgctgggaggaggacggcagctgctcgtgtcctgcccctgccacatcagtgactgctttattcttttccaataaagaagtgcacgtgtcagagctggagcgcctgcattgtgagaaaccaaaaaaaaaaaaaaaaaa

SEQ ID NO: 447 - DNA, 4333 bp, Human
ggcttcctccagttccggagtccagtggctgaccgccttgctggagcggagatgcagccgccgccccgaaaagtgaagccggcccaggaggtgaagcttcgcttcctggaacagctgagcatccttcagacctggcagcagagggaggcggatctgctggaggacatcagatcctacagcaagcagagggcagccattgaacgggagtatgggcaggcactccagaaactggctggcccattcctgaagagggaagggcaccggagcggtgagatggacagcaggggcaggacagtgttcggtgcctggcgctgcctgctggatgccaccgtggctgggggccaaacccgactccaggcgtctgaccgataccgtgacctagcagggggtacagggcggagcgccaaggagcaggtgcttaggaagggaacagagaacctccagagggcgcaggctgaggtgctgcagtctgtccgggagctgagccgaagtcggaagctgtatgggcagcgggaacgtgtgtgggccttggcacaggagaaggcggctgatgtccaggccaggctaaaccgaagtgaccatgggatcttccactctcggaccagtctccagaaactgagcaccaagctgtccgcccagtcagcccagtactcccagcagctgcaagcagcccgcaatgagtacctgcttaacttggtggctaccaatgcccacctcgaccattactaccaggaggaactgccagctctgctcaaggccctggtcagtgagctgtcagagcacttgagggaccccctgacctccctgagccacactgagctggaagccgcagaggtcatcctggagcatgcccaccgcggggagcagacaacctcccaggtaagctgggagcaagacctgaagctgtttcttcaggagcctggtgtattttcccccaccccacctcagcagtttcagccagcagggactgatcaggtgtgtgtcctggagtggggagcagaaggcgtggctggcaagagtggcctggagaaagaggttcagcgcttgaccagccgagctgcccgtgactacaagatccagaaccatgggcatcgggtactgcaacgactggagcagaggcggcagcaggcttcagagcgggaggctccaagcatagaacagaggttacaggaagtgcgagagagcatccgccgggcacaggtgagccaggtgaagggggctgcccggctggccctgctgcagggggctggcttagatgtggagcgctggctgaagccagccatgacccaggcccaggatgaggtggagcaggagcggcggctcagtgaggctcggctgtcccagagggacctctctccaaccgctgaggatgctgagctttctgactttgaggaatgtgaggagacgggagagctctttgaggagcctgccccccaagccctggccacgagggccctcccctgccctgcacacgtggtatttcgctatcaggcagggcgtgaggatgagctgacaatcacggagggtgagtggctggaggtcatagaggagggagatgctgacgaatgggtcaaggctcggaaccagcacggcgaggtaggctttgtccctgagcgatatctcaacttcccggacctctccctcccagagagcagccaagacagtgacaatccctgcggggcagagcccacagcattcctggcacaggccctgtacagctacaccggacagagtgcagaggagctgagcttccctgagggggcactcatccgtctgctgccccgggcccaagatggagtagatgacggcttctggaggggagaatttgggggccgtgttggggtcttcccctccctgctggtggaagagctgcttggccccccagggccacctgaactctctgaccctgaacagatgctgccgtccccttctcctcccagcttctccccacctgcacctacctctgtgttggatgggccccctgcacctgtcctgcctggggacaaagccctggacttccctgggttcctggacatgatggcacctcgactcaggccgatgcgtccaccacctcccccgccggctaaagccccggatcctggccacccagatcccctcacctgaaggccagggaagccttgacccccagtgatgctgctgtccctatcttcaagctgtcagaccacaccatcaatgatccagagcaacacagccaaaagctggaatcgcccttatttccaccctcacctccaagggtggaaacttgccccttcccatttctagagctggaacccactcctttttttcccattgttctatcatctctaggaccggaactaccttctcttctgtcatgaccctatctagggtggtgaaatgcctgaaatctctggggctggaaaccatccatcaaggtctctagtagttctggcccacctctttccccaccctggctccatgacccaccccactctggatgccagggtcactggggttgggctggggagaggaacaggccttgggaatcaggagctggagccaggatgcgaagcagctgtaatggtctgagcggatttattgacaatgaataaagggcacgaaggccaggccagggcctgggcctcttgtgctaagagggcagggggcctacggtgctattgctttaggggcccaccacgggcaggggcctgctcccagctgccacgctctatcatatggagcgaggtgttggggaaggcggggcaggcagcctgttgcaggcaggggaaggagaagagactgaggggctgtgacctctcctgaggcccccagcctgagactgtgcaactccaggtggaagtagagctggtccctcagctggggggcagtgctgtccagtggaggggagggctttcacgcccacccaccccctggccctgccagctggtagtccatcagcacaatgaaggagacttggagaagaggaagaataacactgttgcttcctgttcaagctgtgtccagcttttcccctggggctccaggaccttccctacctccaccaccaaaccaagggatttatagcaaaggctaagcctgcagtttactcggggggttcagggagccgaaaggcttaaatagtttaagtaggtgatgggaagatgagattacctcatttagggctcaggcagactcacctcacatactccctgctccctgtggtagagacacctgagagaaaggggaggggtcaacaatgagagaccaggagtaggtcctatcagtgccccccagagtagagagcaataagagcccagcccagtgcagtcccggctgtgttttcctacctggtgatcagaagtgtctggtttgcttggctgcccatttgcctcttgagtgggcagccctgggcttgggcccctccctccggccctcagtgttggctctgcagaagctctggggttcccttcaagtgcacgaggggttaggctgctgtccctgagtcctccattctgtactggggggctggctaggacctggggctgtggcctctcagggggcagcctctccatggcaggcatccctgccttgggctgccctcccccagacccctgaccaccccctgggtcctgtcccccaccagagccccagctcctgtctgtgggggagccatcacggtgttcgtgcagtccatagcgcttctcaatgtgtgtcacccggaacctgggaggggagggaacactggggtttaggaccacaactcagaggctgcttggccctcccctctgaccagggacatcctgagtttggtggctacttccctctggcctaaggtaggggaggccttctcagattgtggggcacattgtgtagcctgacttctgccggagctcccagtccaggaggaaagagccaaggcccacttttgggatcaggtgcctgatcactgggccccctacctcagcccccctttccctggagcacctgccccacctgcccacagagaacacagtggtctcccctgtccgggggcggctttttccttccttggagcgtccctgacggacaagtggaggcctcttgctgcggctgcaatggaggcaaggggctgcagagcccaggtgcactgtgtgatgatgggagggggctccgtcctgcaggctggaggtggcatccacactggacagcagggaggaggggagtgagggtaacatttccatttcccttcatgttttgtttcttacgttctttcagcatgctccttaaaaccccagaagccccaatttccccaagccccattttttcttgtctttatctaataaactcaatattaagatgttaaaaaaaaaaaaaa

SEQ ID NO: 448 - DNA, 7836 bp, Human
agggggcggagcgcaaaggacagaagctccggcaccgagtcggggcagagtcccgctgagtccgagcgctgctgaggcagctggcgagacggcacgtctggaggcgaggcgggcgcactgaaaggaggccggcgcgcccgcggccccggctcgcgttctgttcaggttcgtgggcctgcagaggagagactcgaactcgtggaacccgcgcaccgtggagtctgtccgcccagtccgtccggggtgcgcgaccaggagagctaggttctcgccactgcgcgctcggcaggcgtcggctgtgtcgggagcgcgcccgccgcccctcagctgcccggcccggagcccgagacgcgcgcaccatgagcggtggtgaagtggtctgctccggatggctccgcaagtcccccccggagaaaaagttgaagcgttatgcatggaagaggagatggttcgtgttacgcagtggccgtttaactggagatccagatgttttggaatattacaaaaatgatcatgccaagaagcctattcgtattattgatttaaatttatgtcaacaagtagatgctggattgacatttaacaaaaaagagtttgaaaacagctacatttttgatatcaacactattgaccggattttctacttggtagcagacagcgaggaggagatgaataagtgggttcgttgtatttgtgacatctgtgggtttaatccaacagaagaagatcctgtgaagccacctggcagctctttacaagcaccagctgatttacctttagctataaatacagcaccaccatccacccaggcagattcatcctctgctactctacctcctccatatcagctaatcaatgttccaccacacctggaaactcttggcattcaggaggatcctcaagactacctgttgctcatcaactgtcaaagcaagaagcccgaacccaccagaacgcatgctgattctgcaaaatccacctcttctgaaacagactgcaatgataacgtcccttctcataaaaatcctgcttcctcccagagcaaacatggaatgaatggcttttttcagcagcaaatgatatacgactctccaccttcacgtgccccatctgcttcagttgactccagcctttataacctgcccaggagttattcccatgatgttttaccaaaggtgtctccatcaagtactgaagcagatggagaactctatgtttttaataccccatctgggacatcgagtgtagagactcaaatgaggcatgtatctattagttatgacattcctccaacacctggtaatacttatcagattccacgaacatttccagaaggaaccttgggacagacatcaaagctagacactattccagatattcctccacctcggccaccgaaaccacatccagctcatgaccgatctcctgtggaaacgtgtagtatcccacgcaccgcctcagacactgacagtagttactgtatccctacagcagggatgtcgccttcacgtagtaataccatttccactgtggatttaaacaaattgcgaaaagatgctagttctcaagactgctatgatattccacgagcatttccaagtgatagatctagttcacttgaaggcttccataaccactttaaagtcaaaaatgtgttgacagtgggaagtgtttcaagtgaagaactggatgaaaattacgtcccaatgaatcccaattcaccaccacgacaacattccagcagttttacagaaccaattcaggaagcaaattatgtgccaatgactccaggaacatttgatttttcctcatttggaatgcaagttcctcctcctgctcatatgggcttcaggtccagcccaaaaacccctcccagaaggccagttcctgttgcagactgtgaaccaccccccgtggataggaacctcaagccagacagaaaagtcaagccagcgcctttagaaataaaacctttgccagaatgggaagaattacaagccccagttagatctcccatcactaggagttttgctcgagactcttccaggtttcccatgtccccccgaccagattcagtgcatagcacaacttcaagcagtgactcacacgacagtgaagagaattatgttcccatgaacccaaacctgtccagtgaagacccaaatctctttggcagtaacagtcttgatggaggaagcagccctatgatcaagcccaaaggagacaaacaggtggaatacttagatctcgacttagattctgggaaatccacaccaccacgtaagcaaaagagcagtggctcaggcagcagtgtagcagatgagagagtggattatgttgttgttgaccaacagaagaccttggctctaaagagtacccgggaagcctggacagatgggagacagtccacagaatcagaaacgccagcgaagagtgtgaaatgaaaatattgccttgccatttctgaacaaaagaaaactgaattgtaaagataaatcccttttgaagaatgacttgacacttccactctaggtagatcctcaaatgagtagagttgaagtcaaaggacctttctgacataatcaagcaatttagacttaagtggtgctttgtggtatctgaacaattcataacatgtaaataatgtgggaaaatagtattgtttagctcccagagaaacatttgttccacagttaacacactcgtagtattactgtatttatgcactttttcatctaaaacattgttctgggttttcccaatgtaccttaccataattcctttgggagttcttgttttttgtcacactactttatataacaatactaagtcaactaagctacttttagatttggaaattgctgtttacagtctaacaacattaaaatgagaggtagattcacaagttagctttctacctgaagcttcaggtgataaccattagcttatacttggactcatcatttgttgccttccaaaatgctgaggataatgtatgtactggtgtcaggacctagttctctggttaatgtacatttagtttttaatggtggaactttgttatattttgttaattacagtgtttttggttcattgagtgaagattctgccgggtgggatcttgcacctttgaaagactgaataattacactaccaagtaagcctgcaaatcattgatggcatgcagtgatgatgtgctcttacacttgttaacatgtattaagtgttatttgcaaaaggtagattatgtaaccaatcaggtacgtaccaggcagtgatgtgctaatacactgatcaggtttagacaatgagctttggttgtgttcttgttagtcctaatattggttttcagtttggaattaataaagcagttgacattcactgttagttacagcaacatactgtgatttttaattagatagtaattcagatttattactctatgaaattctgtcttttgacaccatagtgccctttctatgattttttttacttaatattcttcttggccttatatttaattccctatgcaattaatattttatatctgcatttttttaaaaaaaatagatgttatataagtgattctcgtatgtagcacctgttgcttttccactgaaagaattacggattttgtactgtgatttatattcactgccccaattcaagaaatattggagccttgctacaatgtgaaatgttatagtcatggactccttccaaccagatttctgaaaacaccagagggatggtataattctgtctcacctataacatggtcctgtgacatagatattaagaccacaagttgtagtgaggctacaattatattcgtctgtcttggctttgcaacataatttagaaagcacgtatagttgttttttaaccaagttacatacaatctcatgtactgatttgagacttataacaatttttggagggggcatagagaaaggagtgcccacagttgaggcatgaccccctccattcagacctctaactgttgcctgagtacacagatgtgccctgatttctggcccattggccatagtactgtgcctaatcaatgtaataggtttattttcccaatcctcaaactaaaaatgttcataacaagatgaattgtagactagtaacatttgatgcttttaaatatttgcttctttttaaacaaaaactaaaacccagaagtgaatttttaggtggatttttaaataaaaaagattgattgagtttggtgtgcaagctgttttataatgaaacaacaaaatgaaatctaaaatcctgaaatgtgcctaaactatcaaaacacacgatacagctaatgtgtaaagatgctaaattctgttacttggaggatgaatatatttaagatttaaaacacaataataaatacatgattaattcaaaaataaaaatctttacagctgcctatcaagggtctaaagcacttaatgaatgtttttagtctaacttatcattaactttttacaagtcaccatatttgaagatctgtagcactctgattttcagaaaatttttcattctgaataatttaaaaatggtgatgtattagaaaggcagtttgctttagaaaactaaatcacattgaacattgtattagagaattaaattaaaagtttcttacagagcagtattttccaaacatttttagcactagaatctttttagatgaaattttatgtataaccccaatacataaagcctgaaaactcaattttatcaatataaatgtattttgggttcacatttatgcttattcattttggctcattactaagcataataagattctgagttatttctgaataacacaaatgtggagttatacatagttgatgaaaccagcagccaatttatagctatgccctgttttatttgtatactatcaagaaaattttgattcacacaaatgtaagcaaaaataataggttttaaacatacatctcaggaaattctttaattagagatagctaaagttattcaaggtctatacaaaaataagttatcctggtagtggaagttaatacataagcagtctccagtgtggtaaagtagggtatgtaacacatcagaatgtgcgtttttattaggttttaaaatatgcacgtataaaaactaaatttgaatcaaacccttttaactcacctccaagaagctagactttggccaggaatgggctaaaaaccactggttaacgatgtgacagttatgatcttggagattggaaatctttcttccacattagagttctttaccttaattccttattctgaaaaattgtaagattttatgaaggtttgaatactgaagcacagttctgctttcaaaaattaaaattcaaacttgaaaaagctgtttaacccatggaagatatcatttagtaagatgtaaaagattttttaaatctacacttcagtttatacatctttatcattatcaatactatataagttactgtgagcattttagagaattccataaaggtactatgagtgtgtctgtatgtgtgtgtatatatagcattgtatttaatcatagactaaatttaatttgatatagaaatactactttacttgtacattaaggtcataatttctgctggactcttttatatttaattaatggggattatagtcttccttcataaatgcatttaaacctgaaattgaacaccagtgtttttctttttctacttatgggaagttgtctgcttccccctttagagaaaacagtatttttatattttgttaaaatattaactactttatgcctacacactatgctgtagatactgatcataattcttgggtgttcacaaacactcctagtgcctcttttttggcccgttgaaagtgttggtattactactttcactacagagcctttggccctctaataatgctgaggtgggctgatccttcccatttctgtcttcgggtcattctggtaggtcttctcctccactgtcaagtaagcaatcaggtccgtgacagggattggacatatgaacaaattaagtggatacacacagtgagaaagatacatgcattctatggtaacaactactgtcaataacatctgatgttacatgcacatttatatatatataattttaaaaactgaactatgagaagccatggtataaatgaatattgtggacatcatggacttgatatgatagaaatcaattgtcagcttgagaaagttgtttttaatctgtctaaatagttcatgcattactacagttaaaaatagtttcatttgtcttctatagacttaattttattccggttcagtataatctctgttaacagagtttcagcaaactgattggtcaaggtattaacatagcttctacttcctttacttaaaaagatgtggttttatgtaagttcttgattactgatgatcatcccaaattttgacaacaaaatcatatgtataaatttatttctcccctcttgttcatcatcttttgtaaaggtcccattgtagatcttttctgctaccaaataaaacttttcaaacaatttggtttcaagaccttaaatagacaagttggatactaagattgtgaactgataaggacatataaatttatatttccagcccttccttagagtctttatctgcatcaaaaacccaattctgccattaactgtgcttcccagtcccacctctatatgtcactcattttctgcaacaaagatctcactaaatcatgttgaaacacaagtcatgatcctctctaagtaaatagaaaaagctccctggaaaaactctgttgccacatgcacgtgccctgttactcctccagccagccagtgctgccagcattttattgtgtaaaagtccaaataaataagggcctgcatgcaacctttatcttcagaaactaggttttatatgtaaaatgtgacttgggaaatgattctgtttattaactggctgggatttttcatttctatgaaagtttcaaacatctccagtactttataaaatcccaacaattgctgtaagtcagcactttggtccactcagcccacccagcccacttgcaactctgactcttcactgaatcatatttgggaagtttgggtagggtgaggctatcttcttcaagattattttctcatatgtctgtctgtcaccttgtaaaccatgagactcctgggtatttgcatgtaacttctttgaggaagttaccaccatctctgatatagacacactttttgagttgcagtttctgttagaattttttggagactaacttgccaattctgtgaatgttattgaatatttaaaaagctgggtctgtaatgggaggcattttattagctgttgtgattgggtaacatgtccccttagatttcctgatttaaaattatacaaaattactatttttgataaaataaaggaacacctacagaaaattaagtttctaagatgtttctatacttcattagaaaagattttattactattacttatggttattggtgattaacacttaatgcgtctcctctgattttgtgttccatgaggtgcttggaacatttggagtgctctgtgcgagggacatacagtgatataggaaatttaaaaattaaaataatacccaaaacccactttatcagatatggtattgtgatggttaatattatgtgtcaacttggtgaggctatggcgcccatgtgtttggtcaaacactagcctagatgttgctgtgaatatattttgtagatgtgattaacatttacaatcagttgattttaagtaaagcagattctcatccaaaaaaaaaaaaaaaaa

SEQ ID NO: 449 - DNA, 1538 bp, Human
cagccggctccctccggccgcgaactgcccctccccgccccgcctcccggcgcgggtggccgaggcgtagcgctgcgacccccgcacccctgcgaacatggcgctgcgagtggtgcggagcgtgcgggccctgctctgcaccctgcgcgcggtcccgtcacccgccgcgccctgcccgccgaggccctggcagctgggggtgggcgccgtccgtacgctgcgcactggacccgctctgctctcggtgcgtaaattcacagagaaacacgaatgggtaacaacagaaaatggcattggaacagtgggaatcagcaattttgcacaggaagcgttgggagatgttgtttattgtagtctccctgaagttgggacaaaattgaacaaacaagatgagtttggtgctttggaaagtgtgaaagctgctagtgaactctattctcctttatcaggagaagtaactgaaattaatgaagctcttgcagaaaatccaggacttgtaaacaaatcttgttatgaagatggttggctgatcaagatgacactgagtaacccttcagaactagatgaacttatgagtgaagaagcatatgagaaatacataaaatctattgaggagtgaaaatggaactcctaaataaactagtatgaaataacgcaagccagcagagttgtcttaaattagtggtggatagaagacttagaatagaaacttttagtattaccgatggggaaaaaaaaactactgttaacactgctaatgaaagaaaatgccctttaactttctaatgattatagataaatataatatgcgtctttttcacaatatcctatgatttttagactaggctctagtgttcagaattcatgaaattatccatggtaaaaactagttataaaaattacataattcaaagataacattgttattcttaagccttatataatattgtaacttgcatgtatccatacctggatttgggatgaaatacttaatgatctttccattggaaataactggaagtgaagaggttttgttgcttgtacagtgtcagatgaggaacaccactatcttaattttgcgatacactgcatttgctggtgctatttttatacagtgaagcaacagctttgcagcaaaataataaaatacttcttcgttaatcatgtttgttttgatgttaatatttcatttagtaactctgctagtatttgtgaaagtgctaactttaacttacggaaagttactttttaaaaggaaatttaagccagaacaatgcaaagctccaagaaaatgttttctttagtcacaaatctggtttttcttaagccaagatctgtcacctttaacataataaaaaataaatcaccaactttgattttctatcatgcgaggtctgaagaaagaagaggaaagacagaggaaggtggaagttttgatcagtatagcacatggtgtttttaagttgttaaaccacgttcaggtttccacttaagtcatgggaataaaagtggacaaggactgaagctttatgagctca

SEQ ID NO: 450 - DNA, 1964 bp, Human
ggcgccgctgcgggagaggcccggtctggagtttgcggagggccgagccgggtgcgcacggggaggcggaggcagcggcggcggcggcggcggcggcggcggcggcggagcagatgaagaaactgaggccctgtgatgtgaagtgacttgccccccagccacacagctggaccattctggctgctgtctggacaagaagtcgtagggggtgagggtggaagctgggaaacccacaggaggcaaccacactagtttagatcttctggtgaccccacttctcgctgctcatgccgctgggactggggcggcggaaaaaggcgccccctctagtggaaaatgaggaggctgagccaggccgtggagggctgggcgtgggggagccagggcctctgggcggaggtgggtcggggggcccccaaatgggcttgcccccccctcccccagccctgcggccccgcctcgtgttccacacccagctggcccatggcagtcccactggccgcatcgagggcttcaccaacgtcaaggagctgtatggcaagatcgccgaggccttccgcctgccaactgccgaggtgatgttctgcaccctgaacacccacaaagtggacatggacaagctcctggggggccagatcgggctggaggacttcatcttcgcccacgtgaaggggcagcgcaaggaggtggaggtgttcaagtcggaggatgcactcgggctcaccatcacggacaacggggctggctacgccttcatcaagcgcatcaaggagggcagcgtgatcgaccacatccacctcatcagcgtgggcgacatgatcgaggccattaacgggcagagcctgctgggctgccggcactacgaggtggcccggctgctcaaggagctgccccgaggccgtaccttcacgctgaagctcacggagcctcgcaaggccttcgacatgatcagccagcgttcagcgggtggccgccctggctctggcccacaactgggcactggccgagggaccctgcggctccgatcccggggccccgccacggtggaggatctgccctctgcctttgaagagaaggccattgagaaggtggatgacctgctggagagttacatgggtatcagggacacggagctggcggccaccatggtggagctgggaaaggacaaaaggaacccggatgagctggccgaggccctggacgaacggctgggtgactttgccttccctgacgagttcgtctttgacgtctggggcgccattggggacgccaaggtcggccgctactaggactgcccccggaccctgcgatgatgacccgggcgcaacctggtgggggcccccagcagggacactgacgtcaggacccgagcctccagcctgagcctagctcagcagcccaaggacgatggtgaggggaggtggggccaggccccctgccccgctccaatcggtaccatcccctccctggttcccagtctggccggggtccccggcccccctgtgccctgttccccacctacctcagctgggtcaggcacagggaggggagggatcagccaaattgggcggccacccccgcctccaccactttccaccatcagctgccaaactggtccctctgtctccctggggccttgggttctgtttgggggtcatgaccttcctagtttcctgacgcagggaatacaggggagagggttgtccttccccccagcaaatgcaataatgccctcacccctcctgagaggagccccctccctgtggagcctgttacctccgcatttgacacgagtctgctgtgaaccccgcaacctcctccccacctcccatctctccttccaggcccatccctggcccagagcaggagggagggagggacgatggcggtgggtttttgtatctgaatttgctgtcttgaacataaagaatctatctgctgttggaaaaaaaaaaaaaaaaaaa

SEQ ID NO: 451 - DNA, 3778 bp, Human
gcggcgcggggcggagggcgcccgagggcgagcgggcaggcgggcacggcgggttccgggccagccccggggcggacggttggccgggcgcgcggagcctcgccggggcctcgccggagccgggccgggcagcaggggccgccgccgccgcccgggcccgccgcccgcgccccccacgctggcccagagggctgcggccgcgtcgccgctgaggatgtcccgaaaggggccgcgagcggaggtgtgtgcggactgcagcgccccggaccctggctgggcatccatcagcaggggtgtgctggtgtgtgacgagtgctgcagcgtgcaccggagcctgggacgccacatctccattgtcaagcaccttcgccacagcgcctggcctcccacgctgctgcagatggtgcacacgcttgccagcaacggggccaactccatctgggagcactccctgctggaccccgcacaagtgcagagcggccggcgtaaagccaacccccaagacaaagtccaccccatcaagtcagagttcatcagggccaagtaccagatgctggcatttgtgcacaagcttccctgccgggacgatgatggagtcaccgccaaagacctcagcaagcaactacactcgagcgtgcggacaggcaacctggagacatgtctgcgcctgctctccctgggtgcccaggccaacttcttccacccagagaagggcaccacacctctgcacgtggctgccaaggcaggacagacactgcaggccgagctgcttgtagtgtatggggctgaccctggctcccctgatgttaatggccgcacacccattgactatgccaggcaggcggggcaccatgagctggcggaaaggctggttgagtgccaatatgagctcactgaccggctggccttctacctctgtggacgcaagccggatcacaagaatgggcattacatcatcccacagatggctgacagatctcggcaaaagtgcatgtctcagagccttgacttatccgaattggccaaagctgctaagaagaagctgcaggcgctcagcaaccggctttttgaggaactcgccatggacgtgtatgacgaggtggatcgaagagaaaatgatgcagtgtggctggctacccaaaaccacagcactctggtgacagagcgcagtgccgtgcccttcctgcctgttaacccggaatactcagccacgcggaatcaggggcgacaaaagctggcccgctttaatgcccgagagtttgccaccttgatcatcgacattctcagtgaggccaagcggagacagcagggcaagagcctgagcagccccacagacaacctcgagctgtctctgcggagccagagtgacctcgacgaccaacacgactacgacagcgtggcctctgacgaggacacagaccaggagcccctgcgcagcaccggcgccactcggagcaaccgggcccggagcatggactcctcggacttgtctgacggggctgtgacgctgcaggagtacctggagctgaagaaggccctggctacatcggaggcaaaggtgcagcagctcatgaaggtcaacagtagcctgagcgacgagctccggaggctgcagcgagagatccacaagctgcaggcggagaacctgcagctccggcagcctccagggccggtgcccacacctccactccccagtgaacgggcggaacacacacccatggcgccaggcgggagcacacaccgcagggatcgccaggccttttccatgtatgaacctggctctgccctgaagccctttgggggcccccctggggacgagctcactacgcggctgcagcctttccacagcactgagctagaggacgacgccatctattcagtgcacgtccctgctggcctttaccggatccggaaaggggtgtctgcctcagctgtgcccttcactccctcctccccgctgctgtcctgctcccaggagggaagccgccacacgagcaagctttcccgccacggcagtggagccgacagtgactatgagaacacgcaaagtggggacccactgctggggctggaagggaagaggtttctagagctgggcaaagaggaagacttccacccagagctggaaagcctggatggagacctagatcctgggcttcccagcacagaggatgtcatcttgaagacagagcaggtcaccaagaacattcaggaactgttgcgggcagcccaggagttcaagcatgacagcttcgtgccctgctcagagaagatccatttggctgtgaccgagatggcctccctcttcccaaagaggccagccctggagccagtgcggagctcactgcggctgctcaacgccagcgcctaccggctgcagagtgagtgccggaagacagtgcccccagagcccggcgccccagtggacttccagctgctgactcagcaggtgatccagtgcgcctatgacatcgccaaggctgccaagcagctggtcaccatcaccacccgagagaagaagcagtgacctctctccccacaccctcacctgcaccctaggacctcactggccataggagctgggccactccagacattaatccccaccccaacagagccactggcacaagtgcccttagtgctgccacactccctggcagccaggtgccctggtgcccacccctgtcgagcccctaaggatggggaggtgggggggcaggagcttctgtcccccacattccatgcacctcccctctgtatatagcatctcccccctcctagtgagcaggggcctgcaaggcatcactcccagcccctcgccttctagggcaccctcagcaaaggggcaggtggggacactccaagtggggcagctctccgtacatgcgccccacccccatgagccagttcagccctactgggggctgagcgggggcatcccctcctttgtacatagtctccatggatgtccctgccctgtagccaccagccccttgctgctctccctttaatgccatatggcccctgcctagggcacaggccccaacctgtgtgctggggtccccagcagcaaacactggaaagtctgttttttttttttctttcttcttccccaccccttaattttaactttgtggtaactgagtgcccccgcgtgcctgcgtgttgagtgtgtgggcggcagtgccgttccggaggcctggtccatctggagttttgaggggtgaggggaccagagcagtgggaccagcatggggatcagcttcccttccccacctggagccagggactgtccgggtagccagttttggtcctgccagctgcctccctgatccctccccactctcgccccttctctatgaacttaaatcaaaaaccacttccctccatctcctcctgctcctgcgtggagggggaatgtgtgctggctagggtggaggactgagcacctgagcctggggctggctccccggggtccccgactcagctggtggctgtggagctgagtcccctccccgtaacctctgcaaggccagcacccaccatcactacctgcacctgctgtggtcccaccctctggaggcctgggaacctggctgcagcctgggaaggctggagaggcagacggtgggacccaccagctctctccccatcccgcttcttccctgggggccaggccctacctgtgtggtggtgggtgggctgtcaagacgtgtcatgtacatttgtatcaaaaataaagaagtgaccatgagctgttaaaaaaaaaaaaaaaaaa

SEQ ID NO: 452 - DNA, 4345 bp, Human
gtgattgaattactcagatatgaagatcatcatctaggttttgtgtaaaaggccctggatattttaagtggccattttggatttacagtgtttttggataattttgccccagaagtttattaaaattggcaagaatcgtctgtgaagtgaattgatagtagtgaacaattcagcaagctacttaaaaagagacccaggcagcatttcttcagtattttggttcaaacggattatataactggttacagtatttcagctggtggtaatttttgcctccccttcccccaccccgttgttggggttcttcagccgaaactgagagacgttgatttgtgtactgagtagtttcagcagtttcaaatgactgagtattgctgaagtttcatggcagtttatttttacctttattgaaagttttaggaatttttgacttcagctctttcatgtcacaatgggacactttttctgaatgaagagattgaaagaatacagagtttttttccttttatcttttatttacgtggaaatttaagatgttgcagttttccggcagcatggtagtattgagatagctatgtgtgtctctgtatatgctgatgtttaggaatgctcttcagatgtgaaattttctttttgtttttgctttttggctcgtaaattggatatttcatctggagtggacaagtacaacagtggcaagtacatggaataataaagaagactttgatcttaaatctaaagaacttggctaattcgggagatagccatatgaaaactttaaaacagaagtatgggtagctgacttgaagtaactctatgtcaaatagtcgtaggttaagtatcttcaaagaacttcgatattatttcagaggatacaaaataaaaatacaaactggaaaataaagattacagagaaaaaaccaacaccttcctgtgcagtcctgttggaatttggacttgccatgaggtgttgaagccttgtttcactgagttggagagactggacctaaatggcgcagcatgactttgctccagcctggcttaatttccctactccaccatcatcaacaaaggtcctgaccagcagtttgaaatcgtcattgaattttgagaagcattctgaaaactttgcatggacagagaatcgttatgatgtgaaccgtcgacgacacaactcttcagatggctttgattctgctattgggcgtcctaatggaggtaactttggaaggaaagaaaaaaatggatggcgtacacatggaagaaatggtacagaaaacataaatcatcgaggtggataccatggtggaagttcccgttctcgtagcagtattttccatgcaggaaaaagccaaggactacatgaaaacaacatacctgacaatgaaaccgggaggaaagaagacaagagagaacgcaaacagtttgaagctgaggattttccgtctttaaatcctgagtatgagagagaaccaaatcacaataagtctttagctgcaggtgtgtgggaatatcctccgaatcctaaatctagagctccaaggatgctggtcattaagaaaggtaatacaaaagacttacagctatctggattcccagtagtaggaaatcttccgtcacagccagttaagaatggaactggtccaagtgtttataaaggtttagtccctaaacctgctgctccacctacaaaacctacacaatggaaaagccaaacaaaagaaaataaagttggaacttctttccctcatgagtccacatttggcgttggcaactttaatgcttttaaatcaactgccaagaactttagtccatctacaaattcagtgaaagagcagcctcgtctaaccaaactgacacgaatgcgcactgataagaagagtgaatttttgaaagcattgaaaagagacagagtagaagaggaacatgaagatgaaagccgtgctggctcagagaaggatgacgactcatttaatttacataacagcaatagtactcaccaagaaagggatataaaccgaaacttcgatgaaaatgaaattcctcaagagaatggcaatgcctcagtgatttcccagcagatcattcggtcttcaaccttcccacaaactgatgttctttcaagttcacttgaggcagaacacagattgttaaaggaaatgggctggcaggaagacagtgaaaatgatgaaacatgtgctcccttaactgaggatgaaatgagagaattccaagttattagtgaacagttacagaagaatggtctgagaaaaaatggtattttgaaaaatggcttgatctgtgacttcaagtttggaccgtggaagaacagcactttcaaacccacaactgagaatgatgacacagagacaagtagcagtgatacatcagatgacgacgatgtgtgaaggatttcctaacagctttagaaatcttagtgtgatacatctctcatacagtttggggtgaattgtaaaaatgaagaactataatttatgtagtgaaataccccattagaagaggattttttgggggacttcaatatgaagaaaaccaagaatgttttgttgggctgtgttgaacattatttctttgtaaatgaatgttgtaggaatgaggacttgggttggtccaacattgactttcttcatcactgcaacatttctctgactagcaatgtgacgatgtaacaaatgagattttctcatttaataataaaaaattgtgtaatgttttgcaaagcttctgtcttaaaatgtccaggtcttaagaaaaaaggcagcttacactgttttgcttgcagagtcatatctttttcgtacaatggaaatcctcaagtccactttgtgcggtctccctctccttcccccaaaaaacaacaacaacaaaacaaaaaccaaaaaggaaaatgtagcatgttggctaaaactggagcaaagtgcactaaaacaatttcctgaactcacctgttgtactattcaccttttaaaccataaattgctctttagccatttgtagtgcagtaaatgttacaggaaaagacttggcacattttcttccaaattttaagaggtgattttcaaaagctttattggggtatgttgtcagaccagggttttcagagttgatggaaaagagtcttgtgagaaaacttattttgataaattattacacacgcagaaaaactgatcacactgactggatctgtccacgacatggaaaataaactggattttcagaatattgttgttttctgtagtgttcaaggtattgtttctaaacataaacatactctaaacatgctttattcacttgttaaagtcatacttttaaaagtaataccttactaaagatggtgattacttttccgaggtcagaaaaggaaagctaagcgttttcattatcaaatacacaagcttattaaatgaatgactgttaactactttattttcatttgcacattaattttggaattgtttctgttttgctgctgacggaaatactattttggctctgtgtatatttgtattttgatttttctggtttgtttacccccatttgcttttagctcccccttatgtttaaatatattctaacttatgtaaagagcataatcttagagcaaaaatacttgaggttttatgtcagatctaatcttaagtgtttgttgttttttaaaaagtgttttctcagatggctgcagtgtttttgctatttctgcataaataccctacctggactccccagttttcaccagaaactgttatttttttttgttgttgttcccactgagactgatggtgatggggaaattaaaaacaacacactagcacactcccacaaaacttgaggaagagttagaatggtaataaaatattaaatagaccttatacttaaaataaggtttcactatataatttgtcacaattcaatctaatcagctaaagttaaatgtagttagaattagccacaggagaatgtaaagcatgctttgacgaagctatcggtaacacatattgaatgtctttgagactcttagattgtactatttgcttaatagattaatgaaatttatcagatacaacctgtatttccaaaaacaagctagaaggaacctgaggaatgtggtttacatttgagatccaccttactgtgttttctactttcagaaaagattctgtagttttggtttttggcatctttcttatactcagttttttctgccttaattcccatttaccagcagttaactcatgtttattgtgctttcatgcattgtgatatggaatgtgtttagtaatttactccttataaatatggtaaagtacagtggtaaaaaaaaaaa

SEQ ID NO: 453 - DNA, 2551 bp, Human
actgcgcactgaggtggccacagtcgctaagaaggttgccatcgcgacgcggctgctcgagggtttcgcttccgggttaggcggccgcagaagcgtagaccgagtagcttgagcgcctcttccggttaccttttcccagcgccagaggcgcctagggttggggtcctcgctcaggcacagagacccgacaccgagcggcggcttccccgggatcgagggacgcgcacgccagaggagacgaaaggaacccgggtcggaccagatcggaaccactgaccattgcccatggcggccctaggccctagcagccagaatgtcactgaatacgtcgttcgagttcctaagaatacaaccaaaaaatataacatcatggcttttaatgcagccgacaaagtcaactttgctacgtggaatcaggctcggctggagcgggacttgagcaacaagaaaatctaccaagaggaggagatgcccgaatcgggcgcgggcagtgagttcaaccgcaagcttcgggaggaggctcggaggaagaagtacggcatcgtcctcaaggagttccggcccgaggaccagccctggctgctccgggtcaacggcaaatcaggcaggaagttcaagggcatcaagaagggaggcgtaacagagaacacgtcctactacatcttcacccagtgccccgacggggccttcgaggccttccccgtgcacaactggtacaatttcacaccgctggcccggcatcgcacgctcactgccgaggaggccgaggaggagtgggagaggaggaacaaggtgctgaaccacttcagcatcatgcagcagcggcggctcaaggatcaggaccaggacgaggatgaggaggagaaggagaaacgtggccgcaggaaggcgagcgagctgcgcatccacgacctggaggacgacctggagatgtcgtccgatgccagtgatgccagtggtgaggaggggggcagagtccccaaggccaagaagaaggcgccgctggccaagggcggcaggaaaaagaagaagaagaagggttcagacgacgaggccttcgaggacagcgatgatggggacttcgagggccaagaggtggactacatgtcagacggctccagtagctcccaagaagagcctgagagcaaggccaaggcgccgcagcaggaggaggggcccaagggtgtcgatgagcagagcgacagtagtgaggagagtgaggaggagaagccgcctgaggaggacaaggaggaggaggaggagaagaaggcacccaccccgcaggagaagaagcgcaggaaagacagcagcgaggagtcggacagctcagaggagagcgacattgacagcgaggcctcctcagccctcttcatggcgaagaagaagacgccacccaagagagagcggaagccgtcgggagggagctcaaggggcaacagccgcccaggcacgcccagcgcagagggtggcagcacctcctccaccctgcgggcggctgccagcaaactcgagcaagggaagcgggtgagcgagatgcctgcagccaagcggttgcggctggacacgggaccccagagcctgtctgggaagtcgacaccccagccaccatcaggcaagacaacacccaacagcggcgacgtgcaggtgactgaggatgccgtgcgccgctacctgacacggaagcccatgaccactaaggacctgctgaaaaagttccagaccaagaagacagggctgagcagcgagcagacagtgaacgtgttggcccagatcctcaagcgactcaaccccgagcgcaagatgatcaacgacaaaatgcacttctccctcaaggagtgaggcttggtccaatacatggctctgccccccagaacttaaggctctcactgccccttcgccatcctagagtgaggctctgtccaatacatggctctgccctccagaacttcaggctctcagtgacccttcgacatcctgcttgctccctgactcccagggccccgtagttagcaattctggaaaagttaagccatctcctcctctggcccttccttctggaatcttcagatgcctgttaggccttcttattgtcctcctcctcctggctcggcctccctcacactgaccaagggcctgtgctgcccactgggtaacttctacagttctcccttccacttccctaagtctctcttcagctgtgacttatccaccacatagcccagtaagtcttcagttttggctgggcatgatggtgagcgcctgcagtcccagctacttgggaggctaagcccagttcaaggctgcagtgaactatgatggtgccactgcattccagcctgggtgacagaatgaaatcctggcacaaaaaaaaaaaaaaagtagccaggcatggtggcgggagcctgttgtcccagctgttccgtaggctgaggcacgagattcacttgaacctgggaggtggaggttgctgtgagctgacaccacgccactgcactccagcctgggtgacagtgagactctgtctcaataaataaaaaataataataaattg

SEQ ID NO: 454 - DNA, 781 bp, Human
taggctgcgttggggcctttttttcgcatcctgcttcgtcaggtttataccactttatttggtgtgctgtgttagtcaccatgtctgaaacagtgcctcccgcccccgccgcttctgctgctcctgagaaacctttagctggcaagaaggcaaagaaacctgctaaggctgcagcagcctccaagaaaaaacccgctggcccttccgtgtcagagctgatcgtgcaggctgcttcctcctctaaggagcgtggtggtgtgtcgttggcagctcttaaaaaggcgctggcggccgcaggctacgacgtggagaagaacaacagccgcattaagctgggcattaagagcctggtaagcaagggaacgttggtgcagacaaagggtaccggagcctcgggttccttcaagctcaacaagaaggcgtcctccgtggaaaccaagcccggcgcctcaaaggtggctacaaaaactaaggcaacgggtgcatctaaaaagctcaaaaaggccacgggggctagcaaaaagagcgtcaagactccgaaaaaggctaaaaagcctgcggcaacaaggaaatcctccaagaatccaaaaaaacccaaaactgtaaagcccaagaaagtagctaaaagccctgctaaagctaaggctgtaaaacccaaggcggccaaggctagggtgacgaagccaaagactgccaaacccaagaaagcggcacccaagaaaaagtaaattcagttagaagtttcttctagtaacccaacggctcttttaagagccaccta

SEQ ID NO: 455 - DNA, 4008 bp, Human
gtgacgtcagagcaggaagtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcagtctttgcacatcattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctcatgatgtggggggactcgaccccctgacatggggcagcccatagcaggccttgtgcagtggggggactcgaccccctgacatggggctgcctggagcaggccgcgtgacgtggggctgcctggccgcggctctcacatggtggttcctgctgcactgatggcccaggggtctctggtatccagatggagctctcgcttcctcagcagctgtgactttcacccaggacccaggacgcagccctccgtgggcactgccggcgccttgtctgcacactggaggtcctccattacagaggcccagcgcacatcgctggccccacaaacgttcaggggtacagccatggcagctccttcctctgccgtgagaaaagtgcttggagtacggtttgccacacacgtgactggacagtgtccaattcaaatctttcagggcagagtccgagcagcgcttggtgacagcctgtcctctcctgctctccaaaggccctgctccctgtcctctctcactttacagcttgtgtttcttctggattcagcttctcctaaacagacagtttaattatagttgcggcctggccccatcctcacttcctctttttatttcactgctgctaaaattgtgtttttacctactactttggtggttgtcctcttttcggcaaagttggagcgagtgccaagctctccatctgtggtcctttctgccaagagcgactcatagtaaccaggatgggagagcagctgccttattctgaatcccaaaaattacttgggggtgattgtcacagaggagggacagaaagggtatctgctgaccaccagcctgcctacccatgcccatgtctccattcctgctcaagcgtgtgtgctgggccggggagtccctgtctctcacagcatctagcagtattattaaatggattcattttaaaaatagctcctatattttgtaacatgtctcaaacactcatactgggttccacaatccactgttagaatacctatggttagggcttctgaactaaaataatggaaaattttaacaatttgtatagtgcctggatcattactagtgccataaccctgcttcttcaacatttcacagaacttctcttttatataaaggcaagagcacaaaatgagttcagatgatcacaaacaggtgagttttgttggagaagaaagttggagtaggagactttcacaagtggtttccatggagatagaatgaagcattctgtggtcaagtaagtttagggagctattcatgtttcacttgctttgtggagattcacactatgcactgggaaagtatctgaaaagtcttataataaagaaacaggcttaactttgtgtaagaacactgtttatcaatgtcatttggctatagaaacattttctcctgctgattgtgtgtgtgaaacatgtattaacattccaatgaactagcatttaataaagcacaattttggaaaccctggtaaatgacagtgggaaataacacccgaaaggcaaggacgggcagattggggagggaaaggatgttgggctaagggctgtgagcttatgttacaggcaactgagccactgaagaattttgacgaagaaaatgccaaccaaagcagtcattttaaaagtttatggctgttcagttacaggacaagttgtgaaaagaaag

SEQ ID NO: 456 - DNA, 3844 bp, Human
ccctttcttttacgtttccgacaaaacagtgtctgtgggcagttagaatcttcagtttctgtgagcgtccgcttcgtctgggcacttccggtactcccattcagttccggtccctgtcttttacgtttccggcaaaacatcagtgtctgtgggtagttggaatcttcagttcctgtgagcgtcggcgtcttctgggcctgtggagtttcttggacaggggccgcggggctccaggacggcgcccttagcgacaccatggcccgaaatgcagaaaaggccatgacggccttagcaagatttcgccaggctcagctggaagagggaaaagtgaaggaacgaagaccctttctggcctcagaatgtactgaactgcctaaagctgagaagtggagacgacagatcattggagagatctctaaaaaagtggctcagattcagaatgctggtttaggtgaatttcgaattcgtgacctgaatgatgaaattaacaagctgctaagggagaaaggacactgggaggtccggataaaggagctgggaggtcctgattatggaaaagttggccctaaaatgctggatcatgaaggaaaagaagtcccaggaaaccgaggttacaagtactttggagcagcaaaagatttgcctggtgttagagagctgtttgaaaaagaacgccaggtgcggtggctcatgcctgtaatcccagcactttgggaggctgaggcgggcggatcacaagctcttcctcctcccagaaagacacgtgctgagctcatgaaggcaatcgattttgagtactatggttacctagatgaagatgatggtgttattgtgcctttggaacaggaatatgaaaagaaactcagagccgagttagtggaaaagtggaaagcagagagagaggctcggctggcaagaggagaaaaggaagaggaggaggaagaggaggaagagatcaacatctatgcagtcaccgaggaggagtcggacgaggaaggcagccaggagaaaggaggggacgacagccagcagaagttcattgctcacgtccctgttccctcgcagcaagagattgaggaggcactggtgcgaaggaagaaaatggaactcctccagaagtatgcaagcgagaccctgcaggcccaaagtgaagaagccagaaggctcctggggtattaggacccagctggggctctccttggagttcttccatcccccagtggtacctcaggacccagggctgcagacacaggctggtgctgcaagggctcctgccccattctcagccttccttccctctccttgtctcatgttgaccggagggtaggggtctgtccctggtcttcctggtaggttttgtacacatattttgctactgtgtggatccatttatttttattgtggagtgtatacaacaggttgcgaactggctgcctgtgtcttattttgacttgcactgccattttgaggggagaagaatcaattagtggcaaacatttaaaaatgcaattttttgcagaccaaagtataattttaaaaaatgcaaattttctaaaagacacatctcttgaaaaatgagatgatgtggccaggcgcagtggctcacgcctgtaaccccagcactttgggaggccgaggcgggcgggtcacgaggtcaagagatggagaccatcctggccaacatggtgaaaccccatgtctactaaaaatacaaaaaaattagctgggcgtactggcatgcacctgtagtcccagctgcttgggaggctgaggcaggagaatcacttgaacccgagaggtggaggttgaagtgagccaagatcgtgccattgcactccagcctggcgacagagtgagactctgtcccaaaaaaaaaaaaaaaaaaagatgcacgcaacccacaagtcaatgaccaggtccctctgtgttggttgctgctctgggctctccgttagcccccctccacctgctccactcgctcctgcctgggtggcaggaatttgagtttgctattcctgttttataacctgttctgcagaaacctatttttattaaagatttttataagaaagggaaacctccatgtcttcagcttgttccctgggccaacggctctgaggtgacagtggcattaggatgtgaccagtcactaaggggcactgccttcctgcaggggagtccctgaagccccagccccaagtgtggcaaagacaggaccagatcccaggagtctaggtgggagtgagccgacccaccatggcgtccgtggccacagctgtagacagggctccttgcagtgggctgcaccgtggcctgctgaaagcacacagtggacacgagctgagtccagagcttcctctgaactggggcttagctctccagtggggaaccatggtcagcggctgtagcccctgggcaagatggtgcctggcttcctgccctctgcagggtcatgggagtgtctgggaactcagggtcagggccagatggctgttcctggggcctggggctccagctcaggctgtttgggaataggaggaactcttggcttggagaagcccatcacacagcgggaggcctgggatggttggtctgcggggagcagctcagactgggggtggcagagccgtgtgtggctgtgtgtggccaagtcgggagagtggccagtgctgggccctctctaaggagcccgagggccacaaggactgtggaaaaggtctgagtgagggagtcgggagctagtggctaagggacttgcttgaggacgctccgtgcggccacaaggagaggcccaggcaggaccaggtcaggaggaggctggggcagaggccctggcaggaggtgggtgggcttggtggggatgggagtagccagggtgtaggtgaggatggggaaggggcccccctgcctcctggcttccctgagggctgggctggccaatcccagccctcagtcaagcccggaggcaaatgtgtgcagggaggagaggtgtccaggttgaagctttgggagcccttggaggcagcaaggcagactcgcctctgggacccagcacccagcttgggcctgcaggtggggactcaggagtgaatatcgtgggggctttgagcaagaccctctgggcccagcctcaccttccatactttgaagtcaaggagtggacctgtgctgtctcagtttgctctggggtctgggcagtcctgtggtttgggcagaggcctcagagggccctagggacagactgacccaggtctgagcctcttgggagcgtgcggatggccggcctcagacaggcctggttgtgggtttgtcttccaaggggcacacgcgcactctggtgcttcctggcattcagaagagaatggggaatccagacatcaggccttccttctccctgggaaggatggcaggtgcttggagccaggcctgtcttgagagccagggctctgggtcttcctcctccagtgccctgttccacgccttcagtgcacaaagcactcccctcctgggatctcttcagggatccccgggatgcaaactggccagggattagaattccacatttgagcaaacagactgagagtggagaagcacccagctggacatcctctaggtgttcctggcagaggcccttgctacttgtctgtgcccaaaggccctagagggtcctagatgtgggacaaggtctcagcagggctccagtcccaggcctggaaacagctgggggtgggggaagctggctgggtgggtgtggttatcttttcccagcttgtggctccgaggtgacagaaccaatctcaggaggctttgtttggttaataaaatctactgaatggtttatttt

SEQ ID NO: 457 - DNA, 6055 bp, Human
actgagtcccgggaccccgggagagcggtcaatgtgtggtcgctgcgtttcctctgcctgcgccgggcatcacttgcgcgccgcagaaagtccgtctggcagcctggatatcctctcctaccggcacccgcagacgcccctgcagccgcggtcggcgcccgggctccctagccctgtgcgctcaactgtcctgcgctgcggggtgccgcgagttccacctccgcgcctccttctctagacaggcgctgggagaaagaaccggctcccgagttctgggcatttcgcccggctcgaggtgcaggatgcagagcaaggtgctgctggccgtcgccctgtggctctgcgtggagacccgggccgcctctgtgggtttgcctagtgtttctcttgatctgcccaggctcagcatacaaaaagacatacttacaattaaggctaatacaactcttcaaattacttgcaggggacagagggacttggactggctttggcccaataatcagagtggcagtgagcaaagggtggaggtgactgagtgcagcgatggcctcttctgtaagacactcacaattccaaaagtgatcggaaatgacactggagcctacaagtgcttctaccgggaaactgacttggcctcggtcatttatgtctatgttcaagattacagatctccatttattgcttctgttagtgaccaacatggagtcgtgtacattactgagaacaaaaacaaaactgtggtgattccatgtctcgggtccatttcaaatctcaacgtgtcactttgtgcaagatacccagaaaagagatttgttcctgatggtaacagaatttcctgggacagcaagaagggctttactattcccagctacatgatcagctatgctggcatggtcttctgtgaagcaaaaattaatgatgaaagttaccagtctattatgtacatagttgtcgttgtagggtataggatttatgatgtggttctgagtccgtctcatggaattgaactatctgttggagaaaagcttgtcttaaattgtacagcaagaactgaactaaatgtggggattgacttcaactgggaatacccttcttcgaagcatcagcataagaaacttgtaaaccgagacctaaaaacccagtctgggagtgagatgaagaaatttttgagcaccttaactatagatggtgtaacccggagtgaccaaggattgtacacctgtgcagcatccagtgggctgatgaccaagaagaacagcacatttgtcagggtccatgaaaaaccttttgttgcttttggaagtggcatggaatctctggtggaagccacggtgggggagcgtgtcagaatccctgcgaagtaccttggttacccacccccagaaataaaatggtataaaaatggaataccccttgagtccaatcacacaattaaagcggggcatgtactgacgattatggaagtgagtgaaagagacacaggaaattacactgtcatccttaccaatcccatttcaaaggagaagcagagccatgtggtctctctggttgtgtatgtcccaccccagattggtgagaaatctctaatctctcctgtggattcctaccagtacggcaccactcaaacgctgacatgtacggtctatgccattcctcccccgcatcacatccactggtattggcagttggaggaagagtgcgccaacgagcccagccaagctgtctcagtgacaaacccatacccttgtgaagaatggagaagtgtggaggacttccagggaggaaataaaattgaagttaataaaaatcaatttgctctaattgaaggaaaaaacaaaactgtaagtacccttgttatccaagcggcaaatgtgtcagctttgtacaaatgtgaagcggtcaacaaagtcgggagaggagagagggtgatctccttccacgtgaccaggggtcctgaaattactttgcaacctgacatgcagcccactgagcaggagagcgtgtctttgtggtgcactgcagacagatctacgtttgagaacctcacatggtacaagcttggcccacagcctctgccaatccatgtgggagagttgcccacacctgtttgcaagaacttggatactctttggaaattgaatgccaccatgttctctaatagcacaaatgacattttgatcatggagcttaagaatgcatccttgcaggaccaaggagactatgtctgccttgctcaagacaggaagaccaagaaaagacattgcgtggtcaggcagctcacagtcctagagcgtgtggcacccacgatcacaggaaacctggagaatcagacgacaagtattggggaaagcatcgaagtctcatgcacggcatctgggaatccccctccacagatcatgtggtttaaagataatgagacccttgtagaagactcaggcattgtattgaaggatgggaaccggaacctcactatccgcagagtgaggaaggaggacgaaggcctctacacctgccaggcatgcagtgttcttggctgtgcaaaagtggaggcatttttcataatagaaggtgcccaggaaaagacgaacttggaaatcattattctagtaggcacggcggtgattgccatgttcttctggctacttcttgtcatcatcctacggaccgttaagcgggccaatggaggggaactgaagacaggctacttgtccatcgtcatggatccagatgaactcccattggatgaacattgtgaacgactgccttatgatgccagcaaatgggaattccccagagaccggctgaagctaggtaagcctcttggccgtggtgcctttggccaagtgattgaagcagatgcctttggaattgacaagacagcaacttgcaggacagtagcagtcaaaatgttgaaagaaggagcaacacacagtgagcatcgagctctcatgtctgaactcaagatcctcattcatattggtcaccatctcaatgtggtcaaccttctaggtgcctgtaccaagccaggagggccactcatggtgattgtggaattctgcaaatttggaaacctgtccacttacctgaggagcaagagaaatgaatttgtcccctacaagaccaaaggggcacgattccgtcaagggaaagactacgttggagcaatccctgtggatctgaaacggcgcttggacagcatcaccagtagccagagctcagccagctctggatttgtggaggagaagtccctcagtgatgtagaagaagaggaagctcctgaagatctgtataaggacttcctgaccttggagcatctcatctgttacagcttccaagtggctaagggcatggagttcttggcatcgcgaaagtgtatccacagggacctggcggcacgaaatatcctcttatcggagaagaacgtggttaaaatctgtgactttggcttggcccgggatatttataaagatccagattatgtcagaaaaggagatgctcgcctccctttgaaatggatggccccagaaacaatttttgacagagtgtacacaatccagagtgacgtctggtcttttggtgttttgctgtgggaaatattttccttaggtgcttctccatatcctggggtaaagattgatgaagaattttgtaggcgattgaaagaaggaactagaatgagggcccctgattatactacaccagaaatgtaccagaccatgctggactgctggcacggggagcccagtcagagacccacgttttcagagttggtggaacatttgggaaatctcttgcaagctaatgctcagcaggatggcaaagactacattgttcttccgatatcagagactttgagcatggaagaggattctggactctctctgcctacctcacctgtttcctgtatggaggaggaggaagtatgtgaccccaaattccattatgacaacacagcaggaatcagtcagtatctgcagaacagtaagcgaaagagccggcctgtgagtgtaaaaacatttgaagatatcccgttagaagaaccagaagtaaaagtaatcccagatgacaaccagacggacagtggtatggttcttgcctcagaagagctgaaaactttggaagacagaaccaaattatctccatcttttggtggaatggtgcccagcaaaagcagggagtctgtggcatctgaaggctcaaaccagacaagcggctaccagtccggatatcactccgatgacacagacaccaccgtgtactccagtgaggaagcagaacttttaaagctgatagagattggagtgcaaaccggtagcacagcccagattctccagcctgactcggggaccacactgagctctcctcctgtttaaaaggaagcatccacacccccaactcctggacatcacatgagaggtgctgctcagattttcaagtgttgttctttccaccagcaggaagtagccgcatttgattttcatttcgacaacagaaaaaggacctcggactgcagggagccagtcttctaggcatatcctggaagaggcttgtgacccaagaatgtgtctgtgtcttctcccagtgttgacctgatcctctttttcattcatttaaaaagcatttatcatgccccctgctgcgggtctcaccatgggtttagaacaaagacgttcaagaaatggccccatcctcaaagaagtagcagtacctggggagctgacacttctgtaaaactagaagataaaccaggcaatgtaagtgttcgaggtgttgaagatgggaaggatttgcagggctgagtctatccaagaggctttgtttaggacgtgggtcccaagccaagccttaagtgtggaattcggattgatagaaaggaagactaacgttaccttgctttggagagtactggagcctgcaaatgcattgtgtttgctctggtggaggtgggcatggggtctgttctgaaatgtaaagggttcagacggggtttctggttttagaaggttgcgtgttcttcgagttgggctaaagtagagttcgttgtgctgtttctgactcctaatgagagttccttccagaccgttacgtgtctcctggccaagccccaggaaggaaatgatgcagctctggctccttgtctcccaggctgatcctttattcagaataccacaaagaaaggacattcagctcaaggctccctgccgtgttgaagagttctgactgcacaaaccagcttctggtttcttctggaatgaataccctcatatctgtcctgatgtgatatgtctgagactgaatgcgggaggttcaatgtgaagctgtgtgtggtgtcaaagtttcaggaaggattttacccttttgttcttccccctgtccccaacccactctcaccccgcaacccatcagtattttagttatttggcctctactccagtaaacctgattgggtttgttcactctctgaatgattattagccagacttcaaaattattttatagcccaaattataacatctattgtattatttagacttttaacatatagagctatttctactgatttttgcccttgttctgtcctttttttcaaaaaagaaaatgtgttttttgtttggtaccatagtgtgaaatgctgggaacaatgactataagacatgctatggcacatatatttatagtctgtttatgtagaaacaaatgtaatatattaaagccttatatataatgaactttgtactattcacattttgtatcagtattatgtagcataacaaaggtcataatgctttcagcaattgatgtcattttattaaagaacattgaaaaacttgaaggaatccctttgcaaggttgcattactgtacccatcatttctaaaatggaagagggggtggctgggcacagtggccgacacctaaaaacccagcactttggggggccaaggtgggaggatcgcttgagcccaggagttcaagaccagtctggccaacatggtcagattccatctcaaagaaaaaaggtaaaaataaaataaaatggagaagaaggaatcaga

SEQ ID NO: 458 - DNA, 3175 bp, Human
caagaggtgcagagcaagcgcatgcgtcgtgacggcccggcttaggcgactctgggcgggtctgggccgctccagtgttttggggcacagaagctgtgggaggagctggaggcttcaccgtggtaaccacagcgccgctgctgccccgccttgcaggcctcaggactgtcatcgcctctgggtgtgagggtactttggccaccgtccccggaaataaccgcgcctgcctctcaagataccccatcctctccacgccgctgccgctgccgccatgcaaggggaggacgccagatacctcaaaaggaaagttaaaggagggaatatagatgtacatccatcagaaaaagcactcattgttcactatgaagtggaagctaccattcttggagaaatgggggaccccatgttgggagaacgaaaagaatgtcaaaaaatcattcgacttaagagtctcaatgccaacacagatataacttccctggcaaggaaggtggttgaagaatgtaaactcattcatccttcaaaactaaatgaggtagaacagctgttgtactatctacagaaccgccgtgattcattgtcaggaaaagattgggaagggtcagcaggacttctgaagagggaacacgacctttaaggaggccaacagatcaggagaaggcaaaagggatgtcgattgcccttggcaacacttaccggagaagtctttcagattcagaaactgtttctgtactccaagcaagcttatgtgaagagaaaaaagaaaaatcaagcaagcctaaagatccacctccttttgaaggaatggagattgatgaagttgctaacattaatgacatggatgaatatattgagttattatatgaagatattcctgacaaagttcggggttctgctttgatcctgcagcttgctcgaaatcctgataacttggaagaactactattgaatgaaactgcccttggtgcattagcaagggtcctgagagaagactggaagcaaagtgtcgagttagctacaaacataatttacatctttttttgtttctccagcttttctcaatttcatggacttattactcactataaaattggagctctgtgtatgaatattattgatcatgagttaaaaagacatgagctttggcaagaagaactctcaaagaagaagaaagctgttgatgaagaccctgaaaaccaaaccttgagaaaggattatgaaaaaacctttaaaaagtaccaggggcttgtggtaaaacaggaacagctattacgagttgctctttatttgcttctgaatcttgctgaggatactcgtaccgaactgaaaatgaggaacaagaacatagttcacatgttggtgaaagcccttgatcgggacaattttgagctgctaattttagttgtgtcattcttgaagaaactcagcatttttatggagaataaaaatgatatggtggaaatggatattgttgaaaaactggtgaaaatgataccttgtgagcatgaagacctgctgaatatcaccctccgacttttactaaacctatcctttgacacaggactgaggaataagatggtacaagttggactgcttcccaagctcactgcactcctaggcaatgacaactacaaacaaatagcaatgtgtgttctttaccacataagcatggatgaccgctttaaatcaatgtttgcatacactgactgtataccacagttaatgaagatgctgtttgaatgttcagatgaacgaattgacttggaactcatttctttctgcattaatcttgctgctaacaaaagaaatgtacagcttatctgtgaaggaaatgggctgaagatgctcatgaagagggctctgaagtttaaggatccattgctgatgaaaatgattagaaacatttctcagcatgatggaccaactaaaaatctgtttattgattatgttggggaccttgcagcccagatctctaatgatgaagaagaggagtttgtgattgaatgtttgggaactcttgcaaacttgaccattccagacttagactgggaattggttcttaaagaatataagttggttccatacctcaaggataaactaaaaccaggtgctgcagaagatgatcttgttttagaagtggttataatgattggaactgtatccatggatgactcttgtgctgcattgctagccaaatctggcataatccctgcactcattgaattgctaaatgctcaacaagaagatgatgaatttgtgtgtcagataatttatgtcttctaccagatggttttccaccaagccacaagagacgtcataatcaaggaaacacaggctccagcatatctcatagacctaatgcatgataagaataatgaaatccgaaaggtctgtgataatacattagatattatagcggaatatgatgaagaatgggctaagaaaattcagagtgaaaagtttcgctggcataactctcagtggctggagatggtagagagtcgtcagatggatgagagtgagcagtacttgtatggtgatgatcgaattgagccatacattcatgaaggagatattctcgaaagacctgaccttttctacaactcagatggattaattgcctctgaaggagccataagtcccgatttcttcaatgattaccaccttcaaaatggagatgttgttgggcagcattcatttcctggcagccttggaatggatggctttggccaaccagttggcattcttggacgccctgccacagcatatggattccgccctgatgaaccttactactatggctatggatcttgataaagtatctgtttccatgtgtaatctcagcttagaagaaatctgtgtgggttgggttaattttggatctttgcctaataatgcatgttgatgttattgtgggtctgtgtttgtttttatttttatatgttgttagctgcagattaaccccagcccctctgtcttctgttaagtacagttgatactgacattgttcactcatcaaaccacatcttgatgctaagtaacatttcccatgagccacaaaactgaatgctgaaaagctactagactggaaaacaaacactgcattatgtatgttaagtgactaatttaatttcaattaaaaagcgtaaagtgaaaatgaaaaaaaaaaaaaaaa

SEQ ID NO: 459 - DNA, 6816 bp, Human
ggacggccgagcggcagggcgctcgcgcgcgcccactagtggccggaggagaaggctcccgcggaggccgcgctgcccgccccctcccctggggaggctcgcgttcccgctgctcgcgcctgcgccgcccgccggcctcaggaacgcgccctcttcgccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagatgtgacagcacccttagtggatgagggagctcccggcaagcaggctgccgcgcagccccacacggagatcccagaaggaaccacagctgaagaagcaggcattggagacacccccagcctggaagacgaagctgctggtcacgtgacccaagagcctgaaagtggtaaggtggtccaggaaggcttcctccgagagccaggccccccaggtctgagccaccagctcatgtccggcatgcctggggctcccctcctgcctgagggccccagagaggccacacgccaaccttcggggacaggacctgaggacacagagggcggccgccacgcccctgagctgctcaagcaccagcttctaggagacctgcaccaggaggggccgccgctgaagggggcagggggcaaagagaggccggggagcaaggaggaggtggatgaagaccgcgacgtcgatgagtcctccccccaagactcccctccctccaaggcctccccagcccaagatgggcggcctccccagacagccgccagagaagccaccagcatcccaggcttcccagcggagggtgccatccccctccctgtggatttcctctccaaagtttccacagagatcccagcctcagagcccgacgggcccagtgtagggcgggccaaagggcaggatgcccccctggagttcacgtttcacgtggaaatcacacccaacgtgcagaaggagcaggcgcactcggaggagcatttgggaagggctgcatttccaggggcccctggagaggggccagaggcccggggcccctctttgggagaggacacaaaagaggctgaccttccagagccctctgaaaagcagcctgctgctgctccgcgggggaagcccgtcagccgggtccctcaactcaaagctcgcatggtcagtaaaagcaaagacgggactggaagcgatgacaaaaaagccaagacatccacacgttcctctgctaaaaccttgaaaaataggccttgccttagccccaaacaccccactcctggtagctcagaccctctgatccaaccctccagccctgctgtgtgcccagagccaccttcctctcctaaatacgtctcttctgtcacttcccgaactggcagttctggagcaaaggagatgaaactcaagggggctgatggtaaaacgaagatcgccacaccgcggggagcagcccctccaggccagaagggccaggccaacgccaccaggattccagcaaaaaccccgcccgctccaaagacaccacccagctctgcgactaagcaagtccagagaagaccaccccctgcagggcccagatctgagagaggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcaccccgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagcctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcagcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaa

SEQ ID NO: 460 - DNA, 2705 bp, Human
agagctgcccagtcgcggaagagcagctgttttggcgtccgtttgctgcggtaggaacatggcggatcggctcacgcagcttcaggacgctgtgaattcgcttgcagatcagttttgtaatgccattggagtattgcagcaatgtggtcctcctgcctctttcaataatattcagacagcaattaacaaagaccagccagctaaccctacagaagagtatgcccagctttttgcagcactgattgcacgaacagcaaaagacattgatgttttgatagattccttacccagtgaagaatctacagctgctttacaggctgctagcttgtataagctagaagaagaaaaccatgaagctgctacatgtctggaggatgttgtttatcgaggagacatgcttctggagaagatacaaagcgcacttgctgatattgcacagtcacagctgaagacaagaagtggtacccatagccagtctcttccagactcatagcatcagtggataccatgtggctgagaaaagaactgtttgagtgccattaagaattctgcatcagacttagatacaagccttaccaacaattacagaaacattaaacactatgacacattacctttttagctatttttaatagtcttctattttcactcttgataagcttataaaatcatgattgaatcagctttaaagcatcataccatcattttttaactgagtgaaattattaaggcatgtaatacattaatgaacataatataaggaaacatatgtaaaattctgttatgacataatttatgtctccattttgttgtattggccagtacttttacaaatcaaaacatctctcaagccaaaggagaagacagtaagaacagacataagggacattttagtttgggctagtgtcctgcctcttagaggtggcattgtgtaaatctgagctttgagcaagaaagttttggaaattgtgttgcttttaagaaatagagttagtgtggctggataagaaagtcacatttatgcaaatgtttcttctgctagaacctcatacctgttctagttcatctccacgtttattttaccaagagatcctctgtcaagagaatttcctggctgttgtgaaagaatttttctacatcctgaactatttttcctatttcttttcaccttgctttttttcatccttaatttgcttgtcatcacaatgaagtatgttttttgaatcatcaattctttctcattctccatttatctgaaggttcttttgcccttattaacctctcaacttttattgctgtattctagtcagaccagaacatacttccactacatcagttacttggcatcatttcacctcagtttattattgccaaataataatttgtgtcagcattttcaactatggttattcatccaacccttggatctctttgagtctactgataatctccactggaaaggtggaattgaaatgtggtccacattttaactagctatttcctggggctgtatttttcagaatatgctgagctacatttgctgcaatctgttgctattcagagtttaagtttcaggagaaaacaggaacaatagaacactctgcctgttatttttgttgtaatcaagcttttccacagttcttgaaaagtactatgtttcaaatttcaggaacaccagcgttagctgtaaaagttgcagcaatttattggctagtcatagaaaatttttgaacttttaactgtattttaattgatgtttattaaaaacactttgctatcagatatttggcataaatctgtactcttcattatagttttggggggagagaagattcagtcagaaaacttattcaaagtacctaagtattataaaggagtcaaaaaggtacaaagagaaaaggtcaagacatttttcaaatgagggaaaactaacaggatttatcactagtaaacctgctctaaaagaattcaagggaagctttttaaaaagaagggaagttatagcagaaggaaacttagaatggcaggaataaagaaggcataatgtatagggtaaatataatagacttctcttgaggttttaaaaattacatttgttatttgaaagaaaaaaattaacgttgttgtatgtgattctctgtagaggatatacagtttttttttgttgttcttgtttctgtttttttaaggtgaagtctctgtcacccaagctgaagtgcagttctgtgatcatggctcactgcagcttcaccctgggttcaggtgatcctcccacttcagcctcttcagtaactgggactacaggcatgtactaccacgtccagctaattttttttttcttttttttttagagatggggtctcactctgttgcccaggctaatgccaaactgctaacctcaagatattaatactatacagtagactataagaaattaagtatttgtatcatccctagagcgacacagatttttccctaaaaaactacagattattttcaaaagcattaataaattaaggtggaatactaaaaaagattcaggtaacccaggaacgagaaacagaataaaacaatagtaaacctaaattttattttatttcattaatacagcaataattaaatgtcaatgatctaagctgatttaaatctaaaaactggataagaagctgtggcttgtaattaaaaatagacctttattcactaga

SEQ ID NO: 461 - DNA, 2747 bp, Human
gcctggatggactagccggggccatggccggcgcggcggcggagtcagggcgggagctgtggaccttcgcgggttcccgggacccgagcgcaccgcggctagcctacggctacggcccgggcagcctgcgcgagctgcgggcgcgcgagttcagccgcctggcaggaactgtctatcttgaccatgcaggtgccaccttgttctcccagagccagctcgaaagcttcactagtgatctcatggaaaacacttatggtaatcctcacagccagaacatcagcagcaagctcacccatgacactgtggagcaggtgcgctacagaatcctggcgcacttccacaccaccgcagaagactacactgtgatcttcactgccgggagcacggctgctctcaaactggtggcagaggcctttccatgggtgtcccagggcccagagagcagtgggagtcgcttctgttacctcaccgacagccacacctccgtagtgggtatgcggaacgtgaccatggctataaatgtcatatccaccccggtcaggccagaggacctgtggtctgcagaggaacgtagtgcttcagccagcaacccagactgccagctgccgcatctcttctgctacccagctcagagtaacttttctggagtcagataccccctgtcctggatagaagaggtcaagtctgggcggttgcaccctgtgagcacgcctgggaagtggtttgtgctgctggatgcagcctcctacgtgagcacctcgcctttggacctgtcagctcaccaggccgactttgtccccatctccttctataagatcttcgggtttcctacaggcctgggcgctctgctggtccataatcgtgcggctcctctactgaggaagacctactttggaggagggacagcctctgcgtacctagcaggagaagacttctacatcccgaggcagtcggtagctcagaggtttgaagatggcaccatctcattccttgatgttatcgcgctaaaacatggatttgacaccctagagcgcctcacaggtggaatggagaatataaagcagcacaccttcaccttggctcagtatacctacgtggccctgtcctctctccagtaccccaatggagcccctgtggtgcggatttacagcgattctgagttcagcagccctgaggttcagggcccaatcatcaattttaatgtgctggatgacaaagggaacatcattggttactcccaggtggacaaaatggccagtctttacaacatccacctgcgaactggctgcttctgtaacactggggcctgccagaggcacctgggcataagcaacgagatggtcaggaagcattttcaggctggtcatgtctgtggggacaatatggacctcatagatgggcagcccacaggatctgtgaggatttcatttggatacatgtcgacgctggatgatgtccaggcctttcttaggttcatcatagacactcgcctgcactcatcaggggactggcctgtccctcaggcccatgctgacaccggggagactggagccccatcagcagacagccaggctgatgttatacctgctgtcatgggcagacgtagcctctcgcctcaggaagatgccctcacaggctccagggtttggaacaactcgtctactgtgaatgctgtgcctgtggccccacctgtgtgtgatgtcgccagaacccagccgactccttcagagaaagctgcaggagtcctggagggggcccttgggccacatgttgtcactaacctttatctctatccaatcaaatcctgtgctgcatttgaggtgaccaggtggcctgtaggaaaccaagggctgctatatgaccggagctggatggttgtgaatcacaatggtgtttgcctgagtcagaagcaggaaccccggctctgcctgatccagcccttcatcgacttgcggcaaaggatcatggtcatcaaagccaaagggatggagcctatagaggtgcctcttgaggaaaatagtgaacggactcagattcgccaaagcagggtctgtgctgacagagtaagtacttatgattgtggagaaaaaatttcaagctggttgtcaacattttttggccgtccttgtcatttgatcaaacaaagttcaaactctcaaaggaatgcaaagaagaaacatggaaaagatcaacttcctggtacaatggccaccctttctctggtgaatgaggcacagtatctgctgatcaacacatccagtattttggaacttcaccggcaactaaacaccagtgatgagaatggaaaggaggaattattctcactgaaggatctcagcttgcgttttcgtgccaatattattatcaatggaaaaagggcttttgaagaagagaaatgggatgagatttcaattggctctttgcgtttccaggttttggggccttgtcacagatgccagatgatttgcatcgaccagcaaactgggcaacgaaaccagcatgttttccaaaaactttctgagagtcgtgaaacaaaggtgaactttggcatgtacctgatgcatgcatcattggatttatcctccccatgtttcctgtctgtaggatctcaggtgctccctgtgttgaaagagaatgtggaaggtcatgatttacctgcatctgagaaacaccaggatgttacctcctaaaaaaaatttttagcataaagtttctcttttacagtgaaaaaaaaaaaaaaaaaaaaa

SEQ ID NO: 462 - DNA, 968 bp, Human
ccggctacctgttggtgtgtatgcagagcatccctgtgccccgcggatatagactggcgcgcctctgttgcgcaggcgcagaactacaacttcagggttttccccaacggcctcttttttgcacgttaggagaaactacatttcccataatcctttgttccagggctggagcggctctgggctccggaatcgcccgcagccggtactgcgggacccactgcggatatggctgtcttggctggatccctgttgggccccacgagtaggtcggcagcgttgctgggtggcaggtggctccagccccgggcctggctggggttcccagacgcctggggcctccccaccccgcagcaggcccggggcaaggctcgcgggaatgagtatcagccgagcaacatcaaacgcaagaacaagcacggctgggtccggcgcctgagcacgccggccggcgtgcaggtcatccttcgccgaatgctcaagggccgcaagtcgctgagccattgaggatcgcgacgcagtcggcgggaccctcatggaagcatcgccctcgcctcggaccttgcctggcgctatttttgcagggagctggggagcaggaacgcctcggacctgagtgctctccatattgtggggttgaagtctggatgggagcttgccaagtccctttttaggctttttaattaggaagcatttcgaacctgcgcaacagaccaaagaacagtacaaagaacatccgtgtacccagtaccctgactaccgactacctacaacccgtccctgccccatcctgagttcttttgaagctgatctcaggcatcggattatttcttctgtaaatatttcagaatgtatctctccaagatgagagctcattaaaagacaattacaaagcttatcacatccaaaagaattatcaataattttgaaatattattaaacgtgtaataaatgttcaaagttccacttgc

SEQ ID NO: 463 - DNA, 3574 bp, Human
aagttcctctttggagaggcaagagggcaaagaagctgaggacccagaagacaggattgtgcctaagaaagtggccttggagcagaggcccaaagaaagcggggagagcgccttgcccatcggtaagggaaaggtgctccaggcacagaagcagctaatgcaacggccctgaggcaaatgcaagataactggcaagttccaggaacagcaaggagggcaaggcgcctggagcagaggaagctagcggatcccttgatgagagggaggaactggcccatctctcatgggtcctgcaggcaggccatgagactgtcttttatgcggggcgagataacgaggcatggacgtgttgtgagcggaggcctagcctgttcaaggtctgaatttttacccctagaatgtaagaagcatgggagcagggactttgttttgctccctgccatatccacagccctagaaaaacgtcgggccattgatagctctcagtaaatgcttgacaagtaagtgaatgaacgaatgcacaattaatgaaatgagggctgcgtcaatgaataactgggaatctgactcctgcagggagccttcagcccacaggtgtatgtaagacccgccccgcctctcatccttcgggctcccacccccgccgttaggctgcggttcgcgccgcggtcgccagagggcgcggagcggcggggcttcccgcacggagggctttgcgtgaggcaccgcgtggggcggggctgcgggcgggctcccagctgctgggccctcatcggctgggcctcgtcgaccggcaagcggaacgcggcagcggggctgggcctgtgcggcggccgccggagcgctttggaaggcgcacggggcgaagatggcggcggagcgacaggaggcgctgagggagttcgtggcggtgacgggcgccgaggaggaccgggcccgcttctttctcgagtcggccggctgggacttgcagatcgcgctagcgagcttttatgaggacggaggggatgaagacattgtgaccatttcgcaggcaacccccagttcagtgtccagaggcacagcccccagtgataatagagtgacatccttcagagacctcattcatgaccaagatgaagatgaggaggaagaggaaggccagaggagcaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcagcactgccccccaggtgttgagtaccagctctccagcccaacaggcagaaaatgaagccaaagccagctcttccatcttaatcgacgaatcagagcctaccacaaacatccaaattcggcttgcagacggcgggaggctggtgcagaaatttaaccacagccacaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataaccgcccagccagctgcctggcctccctcctgtgtttcccatggccagtggccatgccccatggggatcgcccctcctgcccccttgtgcacacccagcagtccagtgcaacgtctcctccatagctctgggttcttagatcttggttggacgtttgttttctccttagttgcatttcctgggtttttgtgatgatcaatggactttaatgaaaaaaaaaataaaaacaaccaaaaaaattgaaggaatatcaccagcatgttgtacggaaactctcccactgaagcaggctttaattgctttaaaattatatttatcttggggcctgtgggaggaaacttccttccatcttctctgcataaaaacttgtggcacacaatgcttattcactagtgtgtcccacccgccagccccacagatgactggaggaaggaggggaaatgtgtagaaagaggcttcgccaccacttgttcccacgagaatatgtcacttgcccagataaaactgggcggcagccagagttccctgaagtgggaagtcagagctccatgcacacagtgtcttcagaaggtgaaaataaatatttccctgtgctccttttactcaacccctggggtatctaatcttgccaggtcttggccagttgagattctgttccacctgcctgcctggccctttcctccattaccatccagactgctcgcctcctggggattctcaggggctccattatggcttgatttactccacgtgcagaagtcttgagtggacctaggaggtaggtgggatattttttttcactaggatacagctcatgccaacccatcctaagtgagttcagaatcagggtatcttgccctataagataaacagtcaaaatgccaccgagctgttcactagtgatgtgtggcaaatcaaatcaactgttgaagaaggggtgagttttctgtgctacaagcacctgtcactgttggtacttgcaggaggcttctgctgggtatgttttggaagtgagtgtcactacttggctttgcttagcaggttctgcttcacacttgttctttgacctgctgacttgtgacttgcagaaacataggcagtagtcctagcctggtaaagaccctccaccacccctataagtttgattgctatgcaggtttgggagaggaggcctattgggctcttggatggaaccctttcccgtattaaacaaaccagagacagaatcagtgctgactcaggatctcctggtttggaatcgtaatgtgcctcaatcctctttccaagcaggcctcaccagtctctttctctttcctgcttcacccctgcaatgagccaagaaccaacactacatccacctagaactgcagaagggcttgtggtttcaaccaagacccatcctgagcaagggacttggcttggtgcttttgatcccaaagttcccacaccggcagtggcctgctggggcaatggcatctgtcacggtgttttctccagcaggtggagattatggaacctacatatgggtctggaaaaactgtacactgttgtcaccttgaccattaaaaaccagaatgaggacaatgga

SEQ ID NO: 464 - DNA, 2349 bp, Human
cttccggcccgcccccgcgcggccgcccctcggaccaccggactggcctggggcgggacgtgggcgcgggggcgcggcgtgcggcacgctgcagggctgaagcggcggcggcggtggggactgcacgtagcccggcgctcggcatggctctcctggtgctcggtctggtgagctgtaccttctttctggcagtgaatggtctgtattcctctagtgatgatgtgatcgaattaactccatcgaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaaatattttggacaatgccgataaatgtatgaagttagtatccacatcataaattcagagtgatgtttagcagtaaatcaatattttgaagtgatacacagatgtctttcctccccacaaacttttttaaacaaaaaacaagacctcttttctttagatggtgccacctatgcccaccacaacagagattttacatggaaaccgggctcagtgagaactgatttcctgcccaatatttgtctttgggctgtctctagtgactaattattaaggaatctagctggttatacagttcaaggctttctatgttgttaatgaacctcaaaatagccgttaagacatgaaatacagcagcaggttaccaatgcgaacaggtagttcgcatttatgtaaaacattcagaaaatgaagttttgaatttgttggaacattcaaaggacttgagagcattttattgtaacttaaaaaaataaatacaactgtcactaaaaaaaaaaaaaaaaaa

SEQ ID NO: 465 - DNA, 2166 bp, Human
ggcgtcttgccccgcctcctgcaggcggcccggcgcggtgtttacccgcggtgcatggtggggcggtctccttcggcaaccccggccgaacggccacccagaggctgtgctgagctggcgcagcggcagcagcatgagccggaccctcgcatcggccgtgcccctgtcgagtcccgactactacgagaggctgggccaactccagcacgggctgcgggacagtgaaaagaagagattggacctggaaaagaaactttatgaatataatcagtctgatacatgcagctcgaatatgagactcaaattaagaagatgctatgctcaaaagatagcctgggactaaaagaggaactgacagatgaagacagagaaaaggttgcagtgcacgaggggattaactcaggaacagccatgtcaagaggattgtatcaaccagcaacaatctttatgggccgccaaatgtcagccatcttaagcatgagagatttcagtacagagcacaaatctccccagcccacaaagaacttttcaattcctgacccacattcacaccgacagacagcccagagcagtaatgtgacagacagctgtgtagtacaaactagtaatgacacacagtgcttaaataagtctgacaacatagatggaaaggcatctcttcagattggtgagaaaatgccagtcacagccagtgtattgtctgaggaggaacaaactcattgcttggagataggaagtaacacacgtcatggcaagagtaatttatctgaaggcaaaaagtctgctgaactcaattccccgttacgggaaagattaagtccagagaacagaaccactgatttaaagtgtgacagttccagcggatcagagggagaaatactgacacgggaacatattgaagttgaggaaaaaagagccagcccgccagtctctccgataccagtttcagaatactgtgaatctgaaaataagtggtctcaagagaagcattctccttgggaaggtgtttcagatcatcttgctcacagggaaccaaagtcacaaaagcccttcagaaaaatgcaggaagaggaggaggaaagttggagcaccagcagtgaccttaccatttcaataagtgaagatgatctgattttagagagcccagaaccacagccaaatccaggtggcaagatggagggagaagatggaatagaggccttaaaattaatccatgctgagcaagaaagagttgccctatccactgaaaaaaattgtattttgcaaaccctaagctctcctgattcagaaaaggaatcctccactaacgcaccaacaagagaacctggacaaacaccagactcagacgtaccgagggcacaggtgggtcagcatgttgccaccttgaaagaacatgataattctgtcaaagaagaggcaacagcattattgagaaaagcccttacagaagagtgtggccgtaggtcagctattcacagtagtgaatcatcttgcagcttgccatctattctgaatgacaatagtggaataaaggaagccaaacctgctgtatggctcaacagtgttcctacaagggaacaagaagtttcaagtggctgtggagacaagagcaagaaagaaaatgtggctgcagatatcccaatcacagaaacagaagcctatcagttgctgaagaaggccacccttcaggataatacaaatcaaactgaaaacaggtttcaaaagacagatgcttctgtgtcacacttgtcaggtttgaatattggcagcggtgcattcgagacaaagacagctaacaaaattgcttcggaagctagtttttcatctagtgaaggaagtcctttgtcaaggcatgaaaacaaaaagaaacccgtgatcaatttaaaatctaatgccctctgggatgagtctgatgacagtaactcagaaattgaggctgctttacgccccagaaaccataacaccgatgattctgatgatttttatgactaacgtgctgtgacattggtttcaaataaagtctttaaacaaactaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 466 - DNA, 6356 bp, Human
ccttggcggcggacgtgcagagaatctcgatgctggcctggagcagaaactgagctggaccactggagcctcggtgagggggtgcggggggcaatggcactgcagctctgggccctgaccctgctgggcctgctgggcgcaggtgccagcctgaggccccgcaagctggacttcttccgcagcgagaaagagctgaaccacctggctgtggatgaggcctcaggcgtggtgtacctgggggcggtgaatgccctctaccagctggatgcgaagctgcagctggagcagcaggtggccacgggcccggccctggacaacaagaagtgcacgccgcccatcgaggccagccagtgccatgaggctgagatgactgacaatgtcaaccagctgctgctgctcgaccctcccaggaagcgcctggtggagtgcggcagcctcttcaagggcatctgcgctctgcgcgccctgagcaacatctccctccgcctgttctacgaggacggcagcggggagaagtctttcgtggccagcaatgatgagggcgtggccacagtggggctggtgagctccacgggtcctggtggtgaccgcgtgctgtttgtgggcaaaggcaatgggccacacgacaacggcatcatcgtgagcactcggctgttggaccggactgacagcagggaggcctttgaagcctacacggaccacgccacctacaaggccggctacctgtccaccaacacacagcagttcgtggcggccttcgaggacggcccctacgtcttctttgtcttcaaccagcaggacaagcacccggcccggaaccgcacgctgctggcacgcatgtgcagagaagaccccaactactactcctacctggagatggacctgcagtgccgggaccccgacatccacgccgctgcctttggcacctgcctggccgcctccgtggctgcgcctggctctggcagggtgctatatgctgtcttcagcagagacagccggagcagtggggggcccggtgcgggcctctgcctgttcccgctggacaaggtgcacgccaagatggaggccaaccgcaacgcctgttacacaggcacccgggaggcccgtgacatcttctacaagcccttccacggcgatatccagtgcggcggccacgcgccgggctccagcaagagcttcccatgtggctcggagcacctgccctacccgctgggcagccgcgacgggctcagaggcacagccgtgctgcagcgtggaggcctgaacctcacggccgtgacggtcgccgccgagaacaaccacactgttgcttttctgggcacctctgatggccggatcctcaaggtgtacctcaccccagatggcacctcctcagagtacgactctatccttgtggagataaacaagagagtcaagcgcgacctggtactgtctggagacctgggcagcctgtacgccatgacccaggacaaggtgttccggctgccggtgcaggagtgcctgagctacccgacctgcacccagtgccgcgactcccaggacccctactgcggctggtgcgtcgtcgagggacgatgcacccggaaggccgagtgtccgcgggccgaggaggccagccactggctgtggagccgaagcaagtcctgcgtggccgtcaccagcgcccagccacagaacatgagccggcgggcccagggggaggtgcagctgaccgtcagccccctccctgccctgagcgaggaggacgagttgctgtgcctttttggggagtcgccgccacaccccgcccgcgtggagggcgaggccgtcatctgcaactccccaagcagcatccccgtcacaccgccaggccaggaccacgtggccgtgaccatccagctcctccttagacgaggcaacatcttcctcacgtcctaccagtaccccttctacgactgccgccaggccatgagcctggaggagaacctgccgtgcatctcctgcgtgagcaaccgctggacctgccagtgggacctgcgctaccacgagtgccgggaggcttcgcccaaccctgaggacggcatcgtccgtgcccacatggaggacagctgtccccagttcctgggacccagccccctggtgatccccatgaaccacgagacagatgtgaacttccagggcaagaacctggacaccgtgaagggttcctccctgcacgtgggcagtgacttgctcaagttcatggagccggtgaccatgcaggaatctgggaccttcgcctttcggaccccaaagctgtcccacgatgccaacgagacgctgcccctgcacctctacgtcaagtcttacggcaagaatatcgacagcaagctccatgtgaccctctacaactgctcctttggccgcagcgactgcagcctgtgccgggccgctaaccccgactacaggtgtgcgtggtgcgggggccagagcaggtgcgtgtatgaggccctgtgcaacaccacctccgagtgcccgccgcccgtcatcaccaggatccagcctgagacgggccccctgggtgggggcatccgcatcaccatcctggggtccaatttgggcgtccaagcaggggacatccagaggatctctgtggccggccggaactgctcctttcagccggaacgttactccgtgtccacccggatcgtgtgtgtgatcgaggctgcggagacgcctttcacggggggtgtcgaggtggacgtcttcgggaaactgggccgttcgcctcccaatgtccagttcaccttccaacagcccaagcctctcagtgtggagccgcagcagggaccgcaggcgggcggcaccacactgaccatccacggcacccacctggacacgggctcccaggaggacgtgcgggtgaccctcaacggcgtcccgtgtaaagtgacgaagtttggggcgcagctccagtgtgtcactggcccccaggcgacacggggccagatgcttctggaggtctcctacggggggtcccccgtgcccaaccccggcatcttcttcacctaccgcgaaaaccccgtactgcgagccttcgagccgctacgaagctttgccagtggtggccgcagcatcaacgtcacgggtcagggcttcagcctgatccagaggtttgccatggtggtcatcgcggagcccctgcagtcctggcagccgccgcgggaggctgaatccctgcagcccatgacggtggtgggtacagactacgtgttccacaatgacaccaaggtcgtcttcctgtccccggctgtgcctgaggagccagaggcctacaacctcacggtgctgatcgagatggacgggcaccgtgccctgctcagaacagaggccggggccttcgagtacgtgcctgaccccacctttgagaacttcacaggtggcgtcaagaagcaggtcaacaagctcatccacgcccggggcaccaatctgaacaaggcgatgacgctgcaggaggccgaggccttcgtgggtgccgagcgctgcaccatgaagacgctgacggagaccgacctgtactgtgagcccccggaggtgcagcccccgcccaagcggcggcagaaacgagacaccacacacaacctgcccgagttcattgtgaagttcggctctcgcgagtgggtgctgggccgcgtggagtacgacacacgggtgagcgacgtgccgctcagcctcatcttgccgctggtcatcgtgcccatggtggtcgtcatcgcggtgtctgtctactgctactggaggaagagccagcaggccgaacgagagtatgagaagatcaagtcccagctggagggcctggaggagagcgtgcgggaccgctgcaagaaggaattcacagacctgatgatcgagatggaggaccagaccaacgacgtgcacgaggccggcatccccgtgctggactacaagacctacaccgaccgcgtcttcttcctgccctccaaggacggcgacaaggacgtgatgatcaccggcaagctggacatccctgagccgcggcggccggtggtggagcaggccctctaccagttctccaacctgctgaacagcaagtctttcctcatcaatttcatccacaccctggagaaccagcgggagttctcggcccgcgccaaggtctacttcgcgtccctgctgacggtggcgctgcacgggaaactggagtactacacggacatcatgcacacgctcttcctggagctcctggagcagtacgtggtggccaagaaccccaagctgatgctgcgcaggtctgagactgtggtggagaggatgctgtccaactggatgtccatctgcctgtaccagtacctcaaggacagtgccggggagcccctgtacaagctcttcaaggccatcaaacatcaggtggaaaagggcccggtggatgcggtacagaagaaggccaagtacactctcaacgacacggggctgctgggggatgatgtggagtacgcacccctgacggtgagcgtgatcgtgcaggacgagggagtggacgccatcccggtgaaggtcctcaactgtgacaccatctcccaggtcaaggagaagatcattgaccaggtgtaccgtgggcagccctgctcctgctggcccaggccagacagcgtggtcctggagtggcgtccgggctccacagcgcagatcctgtcggacctggacctgacgtcacagcgggagggccggtggaagcgcgtcaacacccttatgcactacaatgtccgggatggagccaccctcatcctgtccaaggtgggggtctcccagcagccggaggacagccagcaggacctgcctggggagcgccatgccctcctggaggaggagaaccgggtgtggcacctggtgcggccgaccgacgaggtggacgagggcaagtccaagagaggcagcgtgaaagagaaggagcggacgaaggccatcaccgagatctacctgacgcggctgctctcagtcaagggcacactgcagcagtttgtggacaacttcttccagagcgtgctggcgcctgggcacgcggtgccacctgcagtcaagtacttcttcgacttcctggacgagcaggcagagaagcacaacatccaggatgaagacaccatccacatctggaagacgaacagcttaccgctccggttctgggtgaacatcctcaagaacccccacttcatctttgacgtgcatgtccacgaggtggtggacgcctcgctgtcagtcatcgcgcagaccttcatggatgcctgcacgcgcacggagcataagctgagccgcgattctcccagcaacaagctgctgtacgccaaggagatctccacctacaagaagatggtggaggattactacaaggggatccggcagatggtgcaggtcagcgaccaggacatgaacacacacctggcagagatttcccgggcgcacacggactccttgaacaccctcgtggcactccaccagctctaccaatacacgcagaagtactatgacgagatcatcaatgccttggaggaggatcctgccgcccagaagatgcagctggccttccgcctgcagcagattgccgctgcactggagaacaaggtcactgacctctgacctacaatctccagtgctgccttgggacataggtacctgaggtacctgagagcccctcaggggaggaggccgagtggctgtggctgaggcccccaccctcccctggaacgcgccccaagccggagtgggtgcagccggaacccgcccagcgtctagactgtagcatcttcctctgagcaataccgccgggcaccgcaccagcaccagccccagccccagctccctccggccgcagaaccagcatcgggtgttcactgtcgagtctccagtgatttgaaaatgtgccttacgctgccacgctgggggcagctggcctccgcctccgcccacgcaccagcagccgcctccatgccctaggttgggcccctgggggatctgagggcctgtggcccccagggcaagttcccagatcctatgtctgtctgtccaccacgagatgggaggaggagaaaaagcggtacgatgccttcctgacctcaccggcctccccaagggtgccggcactctgggtggactcacggctgctgggccccacgtcaaaggtcaagtgagacgtaggtcaagtcctacgtcggggcccagacatcctggggtcctggtctgtcagacaggctgccctagagccccacccagtccggggggactgggagcagttccaagaccaccccacccctttttgtaaatcttgttcattgtaaatcaaatacagcgtctttttcactctgaaaaaaaaaaaaaaaaaaaaa

SEQ ID NO: 467 - DNA, 2432 bp, Human
aagcagcggccgctcagtctgggcgcttgcaggctgctaaacccaaccgcagttgactagcacctgctaccgcgcctttgcttcctggcgcacgcggagcctcctggagcctgccaccatcctgcctactacgtgctgccctgcgcccgcagccatgtgccgcaccctggccgccttccccaccacctgcctggagagagccaaagagttcaagacacgtctggggatctttcttcacaaatcagagctgggctgcgatactgggagtactggcaagttcgagtggggcagtaaacacagcaaagagaatagaaacttctcagaagatgtgctggggtggagagagtcgttcgacctgctgctgagcagtaaaaatggagtggctgccttccacgctttcctgaagacagagttcagtgaggagaacctggagttctggctggcctgtgaggagttcaagaagatccgatcagctaccaagctggcctccagggcacaccagatctttgaggagttcatttgcagtgaggcccctaaagaggtcaacattgaccatgagacccacgagctgacgaggatgaacctgcagactgccacagccacatgctttgatgcggctcaggggaagacacgtaccctgatggagaaggactcctacccacgcttcctgaagtcgcctgcttaccgggacctggctgcccaagcctcagccgcctctgccactctgtccagctgcagcctggacgagccctcacacacctgagtctccacggcagtgaggaagccagccgggaagagaggttgagtcacccatccccgaggtggctgcccctgtgtgggaggcaggttctgcaaagcaagtgcaagaggacaaaaaaaaaaaaaaaaaaaaaaaaaatgcgctccagcagcctgtttgggaagcagcagtctctccttcagatactgtgggactcatgctggagaggagccgcccacttccaggacctgtgaataagggctaatgatgagggttggtggggctctctgtggggcaaaaaggtggtatgggggttagcactggctctcgttctcaccggagaaggaagtgttctagtgtggtttaggaaacatgtggataaagggaaccatgaaaatgagaggaggaaagacatccagatcagctgttttgcctgttgctcagttgactctgattgcatcctgttttcctaattcccagactgttctgggcacggaagggaccctggatgtggagtcttcccctttggccctcctcactggcctctgggctagcccagagtcccttagcttgtacctcgtaacactcctgtgtgtctgtccagccttgcagtcatgtcaaggccagcaagctgatgtgactcttgccccatgcgagatatttatacctcaaacactggcctgtgagccctttccaagtcagtggagagccctgaaaggaggctcacttgaatccagctcagtgctctgggtggccccctgcaggtggcccctgaccctgcgttgcagcagggtccacctgtgagcaggcccgccctggggcctcttcctggatgtgccctctctgagttctgtgctgtctcttggaggcagggcccaggagaacaaagtgtggaggcctcggggagtggcttttccagctctcatgccccgcagtgtggaacaaggcagaaaaggatcctaggaaataagtctcttggcggtccctgagagtcctgctgaaatccagccagtgttttttgtggtatgagaacaggcaaaaagagatgccccgagatagaaggggagccttgtgtttctttcctgcagacgtgagatgaacactggagtgggcagaggtggcccaggaccatggcacccttagagtgcagaagctggggggagaggctgcttcgaagggcaggactggggataatcagaacctgcctgtcacctcagggcatcactgaacaaacatttcctgatggcaactcctgcggcagagcccaggctggggaagtgaactacccagggcagcccctttgtggcccaggataatcaacactgttctctctgtaccatgagctcctccaggagattatttaagtgtattgtatcattggttttctgtgattgtcataacattgtttttgttattgttggtgctgttgttatttattattgtaatttcagtttgcctctactggagaatctcagcaggggtttcagcctgactgtctccctttctctaccagactctacctctgaatgtgctgggaacctcttggagcctgtcaggaactcctcactgtttaaatatttatttattgtgacaaatggagctggtttcctagatatgaatgatgtttgcaatccccattttcctgtttcagcatgttatattcttataaaataaaagcaaaagtcaaatatga

SEQ ID NO: 468 - DNA, 3493 bp, Human
agaagttaggaggtctgcgtctgggtctcggctcaccctggggggccgcggccatggggcttagttcctagcctaggaagggaaactgagactctgggaggggcaggaacgcccccaaggtcacttggaaagtcgggcaggatgtgctgttagggggaagacccgggcagggtttttgttccccgctgacgacgcctcctttgtgtgttcgcgccgccgccccgccatcgtggggcctgcgagtttgccggggtgcgtgggccgcgtggcggggccttttgtaggtcgggaggatctgagtacgggtgcgggcctgaccgtgggggcgccgaggtcgcagtctaaaacttagtagggcctcgatttccgggcgcgcttccgggccccggctggtggttggtggaacgtgcgactgtgaggcttgcggcccagccctgcaccgctcgggcccttcaccgctctggcgcgcctatagacaggtgtatgaagattctcacgacccgaaacagagttgctagtaaacaccgcttttccgcctttgatccatcgagggaagagggaaaaggatagagcttgggcaagccgttttggtggaatctcactctgtcacccaggatgcagtgcactggcgtgttctcggtctcactgtaacctctgccatctgggctcaagtgattctcctgcctcagcctccggagtagctgggattacaggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacaagaaagcgtcgtggtggagcaataaattctagacaagctcagaagcgaactcgggaagcaacctccacccccgagatctccttggaagcagaacccatagaactcgtggaaactgctggagatgaaattgtggacctcacttgtgaatctttagagcctgtggtggttgatctgactcacaatgactctgttgtgattgttgacgaaagaagaagaccaaggaggaatgctaggaggctgccccaggaccatgctgacagctgtgtggtgagcagtgacgatgaggagttgtccagggacagagacgtatatgtgactacccatactcccagaaacgccagggatgagggcgctacaggcctcaggccctcaggtactgtcagttgtcccatctgcatggacggatactcagagatcgtgcagaatggacgtctcatcgtttccacagaatgcggccatgtcttctgtagccagtgcctccgtgattccctgaagaatgctaatacttgcccaacttgtaggaaaaagatcaaccacaaacggtaccaccccatttatatatgaagtattcagagccccccaggagagacggatggacagacagacagccaggttctccagtggtatctgcctccattttcctgagatcaaaaagactgtttcgaaaccaacatctgatatgtaaactgctcttttgtttccaaccccttccttttgttatctccagtttgatgctatggcgctggacccagggccctcccaggccatctctgttcctctggggtggtccagttctagagtgggagaaagggagtcaggcgcattgggaatcgtggttccagtctggttgcagaatctgcacatttgccaagaaattttccctgtttggaaagtttgccccagctttcccgggcacaccaccttttgtcccaagtgtctgccggtcgaccaatctgcctgccacacattgaccaagccagacccggttcacccagctcgaggatcccaggttgaagagtggccccttgaggccctggaaagaccaatcactggacttcttcccttgagagtcagaggtcacccgtgattctgcctgcaccttatcattgatctgcagtgatttctgcaaatcaagagaaactctgcagggcactcccctgtttcctaagaacgaaaaagtgcaataaaggccattcgttacctacttttcagcagcccacaagatgtagcactattagtgtccccctcagaggcttaatgttgcctgtggagcagtgcccatcccagcccgtttctgcccaccagttgttctcaggaaccttacccatgctccagcgtccttcacctggcacaggacatgcaagataaatagggcaggcacgtgtttgggtgtcctctcttttctgataaaatccatcccgtgtttgccacacgccctccagtcctcagttcccactgcctaacgtctgcccccgtgtagatactgagaggtggtggcagtaattgtggccttatcagccgctcagttccaggcttttgcccaggtcactgttgccccatgttcggagaacctggcccacctgtcttggctttctcatccttcccaacccagtgccgtttatttcagaagcttcctggccactgggcttggatgcttcgggcttctgactgctccataggttttgactggtgaaacaggggcccagatgacaacctctccttcgctccacaggtacgcgggagcctcaggttctctcaggggcagcaaagtggcccaagctgcccctgacagcacagggcctggggggtggctaacgagagaggccttacagtgccggcatgcctcctcttccactgtcgtccttcctcagagggcctcacgccaaacaaacggccttttcgtgtgaaacatcttcagggcgggaaaggggccacttctggctttgttagcaataactgaccttcagtttacccttctgaaggagcagggactcagcacagaattcactttagacggggctgaaggagtgtccctcctctatgtgaaaagaaaattgttttattcttcattctgactttttaactgtttggctcacttccagttagtttgaatgaaaataataattttctacttggagttgaagagggcagaatccgcagctctcatcattgtgatgtgtagcatgtctgccctctgactggacatcattgccattaactttcttctgggcatcacggcaatgtcacgatgcccagacttggagcaaggcaaccttggagtcagtccactcataaaatatggtaacacccattttaaaatttaagttttgtccttaaagacaacttcagtggttaattataaaagttgtgttacttcgtcctaaattaaattgatagaaagatttaaaaatgtgttttgtttctactattcagaaactgcgaactagggaaaggttggtatgaagaaatgtctttccttttttcaatgtacatagttcaactctttctttgttacatttaaactatatccatggatatcagtctgctttggactcctctgctagtgttacagatggaaataaaaccattaatttgaaccaaataaaaaaaaaaa

SEQ ID NO: 469 - DNA, 1035 bp, Human
ggcccttttcccaccccctagcgccgctgggcctgcaggtctctgtcgagcagcggacgccggtctctgttccgcaggatggggtttgttaaagttgttaagaataaggcctactttaagagataccaagtgaaatttagaagacgacgagagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctgaaagcaaggaatttaatgcagaagtacatcggaagcacatcatgggccagaatgttgcagattacatgcgctacttaatggaagaagatgaagatgcttacaagaaacagttctctcaatacataaagaacagcgtaactccagacatgatggaggagatgtataagaaagctcatgctgctatacgagagaatccagtctatgaaaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaaacccagcaattttctatgattttttcagatatagataataaacttatgaacagcaactaaaaa

SEQ ID NO: 470 - DNA, 1135 bp, Human
gggcagagggaataagaggctgcctctgcccaccagtcctgccgcccaggacccgcagcagagacgacgcctgcagcaaggagaccaggaaggggtgagacaaggaagaggatgtctgagctggagaaggccatggtggccctcatcgacgttttccaccaatattctggaagggagggagacaagcacaagctgaagaaatccgaactgaaggagctcatcaacaatgagctttcccatttcttagaggaaatcaaagagcaggaggttgtggacaaagtcatggaaacactggacaatgatggagacggcgaatgtgacttccaggaattcatggcctttgttgccatggttactactgcctgccacgagttctttgaacatgagtgagattagaaagcagccaaacctttcctgtaacagagacggtcatgcaagaaagcagacagcaagggcttgcagcctagtaggagctgagctttccagccgtgttgtagctaattaggaagcttgatttgctttgtgattgaaaaattgaaaacctctttccaaaggctgttttaacggcctgcatcattctttctgctatattaggcctgtgtgtaagctgactggccccagggactcttgttaacagtaacttaggagtcaggtctcagtgataaagcgtgcaccgtgcagcccgccatggccgtgtagaccctaacccggagggaaccctgactacagaaattaccccggggcacccttaaaacttccactacctttaaaaaacaaagccttatccagcattatttgaaaacactgctgttctttaaatgcgttcctcatccatgcagataacagctggttggccggtgtggccctgcaagggcgtggtggcttcggcctgcttcccgggatgcgcctgatcaccaggtgaacgctcagcgctggcagcgctcctggaaaaagcaactccatcagaactcgcaatccgagccagctctgggggctccagcgtggcctccgtgacccatgcgattcaagtcgcggctgcaggatccttgcctccaacgtgcctccagcacatgcggcttccgagggcactaccgggggctctgagccaccgcgagggcctgcgttcaataaaaag

SEQ ID NO: 471 - DNA, 2863 bp, Human
gtgcccctgcagagcgaggcagagagcaactaaaagaaatttctcctgattggagggtgggtgggatgaggctgggggagggggccggggtgtgtgtcccactgtcatgtaaatatcccttccaggcagggcggctccagtgcagatttaagccgctggcacctggggcagtctcagtgttcagcctgcttccggacgggcgaggagactcgtggtctggttctgggacttccctaacagcatggcccctaaacgccagtctccactcccgcctcaaaagaagaaaccaagaccacctcctgctctgggaccggaggagacatcggcctctgcaggcttgccgaagaagggagaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtcttttttttttttttttttttttttccctcttgtgctcagtcgccctgttcttgaggtctcttttctctactccatggttctcaatttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctggaagctggagggtgctaggcccctgtgtagtagtgcatagaattctagcttttttcctcctttctctgtatattgggctcagagagtacactgtgtctctatgtgaatatggacagttagcatttaccaacatgtatctgtctactttctcttgtttaaaaaaagaaaaaaaaacttaaaaaaatggggttatagaaggtcagcaaagggtgggtttgagatgtttgggtgggttaagtgggcattttgacaacatggcttctcctttggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgtacacaaaggatttgatgcttttctctcagcataggtatgcttactatgaccttccaagtttgacttgtataacatcactgtcaaactttgtcaccctaacttcgtattttttgatacgcactttgcaggatgacctcagggctatgtggattgagtaatgggatttgaatcaatgtattaatatctccatagctgggaaacgtgggttcaatttgccattggtttctgaaagtattcacatcatttgggataccagatagctcaatactctctgagtacattgtgcccttgatttttatctccaagtggcagtttttaaaattggccttttacctggatataaattaattgtgcctgccaccaccatccaacagacctggtgctctaatgccaagttatacacgggacagttgctggcatgtcttcattggctatataaaatgtggccaagaagataggctctcagtaagaagtctgatggtgagcagtaactgtccctgctttctggtataaagctctcaaatgtgaccatgtgaatctgggtgggataatggactcagctctgtctgctcaatgccattgtgcagagaagcaccctaatgcataagctttttaatgctgtaaaatatagtcgctgaaattaaatgccactttttcagaggtgaattaatggacagtctggtgaacttcaaaagctttttgatgtataaaacttgataaatggaactattccatcaataggcaaaagtgtaacaacctatctagatggatagtatgtaatttctgcacaggtctctgtttagtaaatacatcactgtataccgatcaggaatcttgctccaataaaggaacataaagattttttttggaaaaaaaaaaaaaaaaaa

SEQ ID NO: 472 - DNA, 3073 bp, Human
tgtgtcatccgccattttgtgagaagcaaggtggcctccacgtttcctgagcgtcttcttcgcttttgcctcgaccgccccttgaccacagacatgtctcgggatcggttccggagtcgtggcggtggcggtggtggcttccacaggcgtggaggaggcggcggccgcggcggcctccacgacttccgttctccgccgcccggcatgggcctcaatcagaatcgcggccccatgggtcctggcccgggccagagcggccctaagcctccgatcccgccaccgcctccacaccaacagcagcaacagccaccaccgcagcagccaccgccgcagcagccgccaccgcatcagccgccgccgcatccacagccgcatcagcagcagcagccgccgccaccgccgcaggactcttccaagcccgtcgttgctcagggacccggccccgctcccggagtaggcagcgcaccaccagcctccagctcggccccgcccgccactccaccaacctcgggggccccgccagggtccgggccaggcccgactccgaccccgccgcctgcagtcacctcggcccctcccggggcgccgccacccaccccgccaagcagcggggtccctaccacacctcctcaggccggaggcccgccgcctccgcccgcggcagtcccgggcccgggtccagggcctaagcagggcccaggtccgggtggtcccaaaggcggcaaaatgcctggcgggccgaagccaggtggcggcccgggcctaagtacgcctggcggccaccccaagccgccgcatcgaggcggcggggagccccgcgggggccgccagcaccacccgccctaccaccagcagcatcaccaggggcccccgcccggcgggcccggcggccgcagcgaggagaagatctcggactcggaggggtttaaagccaatttgtctctcttgaggaggcctggagagaaaacttacacacagcgatgtcggttgtttgttgggaatctacctgctgatatcacggaggatgaattcaaaagactatttgctaaatatggagaaccaggagaagtttttatcaacaaaggcaaaggattcggatttattaagcttgaatctagagctttggctgaaattgccaaagccgaactggatgatacacccatgagaggtagacagcttcgagttcgctttgccacacatgctgctgccctttctgttcgtaatctttcaccttatgtttccaatgaactgttggaagaagcctttagccaatttggtcctattgaaagggctgttgtaatagtggatgatcgtggaagatctacagggaaaggcattgttgaatttgcttctaagccagcagcaagaaaggcatttgaacgatgcagtgaaggtgttttcttactgacgacaactcctcgtccagtcattgtggaaccacttgaacaactagatgatgaagatggtcttcctgaaaaacttgcccagaagaatccaatgtatcaaaaggagagagaaacccctcctcgttttgcccagcatggcacgtttgagtacgaatattctcagcgatggaagtctttggatgaaatggaaaaacagcaaagggaacaagttgaaaaaaacatgaaagatgcaaaagacaaattggaaagtgaaatggaagatgcctatcatgaacatcaggcaaatcttttgcgccaagatctgatgagacgacaggaagaattaagacgcatggaagaacttcacaatcaagaaatgcagaaacgtaaagaaatgcaattgaggcaagaggaggaacgacgtagaagagaggaagagatgatgattcgtcaacgtgagatggaagaacaaatgaggcgccaaagagaggaaagttacagccgaatgggctacatggatccacgggaaagagacatgcgaatgggtggcggaggagcaatgaacatgggagatccctatggttcaggaggccagaaatttccacctctaggaggtggtggtggcataggttatgaagctaatcctggcgttccaccagcaaccatgagtggttccatgatgggaagtgacatgcgtactgagcgctttgggcagggaggtgcggggcctgtgggtggacagggtcctagaggaatggggcctggaactccagcaggatatggtagagggagagaagagtacgaaggcccaaacaaaaaaccccgattttagatgtgatatttaggctttcattccagtttgttttgtttttttgtttagataccaatcttttaaattcttgcattttagtaagaaagctatctttttatggatgttagcagtttattgacctaatatttgtaaatggtctgtttgggcaggtaaaattatgtaatgcagtgtttggaacaggagaatttttttttcctttttatttctttattttttcttttttactgtataatgtccctcaagtttatggcagtgtaccttgtgccactgaatttccaaagtgtaccaatttttttttttttactgtgcttcaaataaatagaaaaatagttataatattgatcttcaactttgccattcatgcttctatgcatattaggctacgtattccacattgaaagcatgagagtgtctaggcctttgaatggcatatgccatttctgggaaatgcatctggaggctaagtattgctttctacaaataattgccccctttgttttaaaaagaagaaatgcatattgaagtagtttgatgatttgtttggcatataggaagcacgctggtgctaagtattttttaaatggttatgtaagcaaagctgaactgtaaatcttcaggaatatgtattaagattgtggaatgggtgtaagacaattggtagggggtgaaagtgggtttgattaaatggatcttttatggccctatgatctatcctttacttgaaagcttttgaaaagtggaaaggtcattttgttgcatttccccatttcttgtttttaaaagaccaacaaatctcaagccctataaatggcttgtattgaacttttacatttgaattaaagatgttaaacatgaa

SEQ ID NO: 473 - DNA, 2745 bp, Human
gttggcgccagcatccaggtaccgcgcgccacagcacctgcctgggcgttcccgcgcttggggcggggcttcccgcgtcccctttaagaggccgcatcacccgcccttgacgtcagagtgtttctccgcaagagcccgtgtcccgctaggctccgcgccctcgcgcccatagccccggcggcggcacgaccagaggcggccaggggagcgcgccgccccgctcggccctccagtcccgctccgccgcctccctcccgcacagcagccgccagcgcggcctcctgcaccatgtcggtggccggcctcaagaagcagttccataaagccactcagaaagtgagtgagaaggttggaggagctgaaggaaccaagctagatgatgacttcaaagagatggaaaggaaagtggatgtcaccagcagggctgtgatggaaataatgactaaaacaattgaataccttcaacccaatccagcttccagagctaagctcagcatgatcaacaccatgtcaaaaatccgtggccaggagaaggggccaggctatcctcaggcagaggcgctgctggcagaggccatgctcaaatttggaagagagcttggagatgattgcaactttggcccagcacttggtgaggtcggggaggccatgcgggaactgtcggaggtcaaagactctttggacatagaagtgaagcagaacttcattgaccctcttcagaatcttcatgacaaagatcttagggaaattcaacatcatctaaagaagttggagggtcgacgcctggattttgattataagaagaaacgacaaggcaagattccggatgaagagcttcgtcaagctctagagaaatttgatgagtctaaggaaattgctgagtcaagcatgttcaatctcttggagatggatattgaacaagtgagccagctctctgcacttgtgcaagctcagctggagtaccacaagcaggcagtccagatcctgcagcaagtcacggtcagactggaagaaagaataagacaggcttcatctcagcctagaagggaatatcaacctaaaccacgaatgagcctggagtttccaactggagacagtactcagcccaatgggggtctctcccacacaggcactcccaaaccttcaggtgtccaaatggatcagccctgctgccgagctctgtacgactttgaacctgaaaatgaaggggagttgggatttaaagagggcgatatcatcacactcactaaccaaattgatgagaactggtatgaggggatgctgcatggccattcaggcttcttccccatcaattatgtggaaattctggttgccctgccccattaggatgttatgctggctggctcgcctcctcttgacccagatagttacggttaaccactgctttggcaatgctgcttataacacatcccaagtgcaggccgcagtggtccacgtcatccagccccaccaagtgactttggttgacttgtgggctcccacaggagtcatggtgatggatgatatcctcttagcctggtgggcgtggcatgtgctttttaaaacatcatctgagaccagccagtagtcacagaactgctgtttacacagttctcaggaggctgtggtttcttagaatatgaccatgagccatttcacagaaaaaccatcccaccgaagatattgtctatcaccccaggggccatctgaaggtctctttgcatttctccatgcaaagaggagaaagcttttgctttcacactgtcccttcccaaatatgtgagtcatggaattgtcaaagtaagccttccctcaccagcaaattgtctcctgatctgaatgaatttgtctcttaatgcatccatagaaaagtgttaattgtgggttcaaagcattctctgcaaataggcatctcagctcctcacacttatggctatttctgacgtatagccagttttcttccctccttgctattaaagccagagcggtaattccaaattatttttcagtaagacagttaatcagcattattgtgagagggactgaaaagaaattctccattatgaggaattgggaagaaatctggtatccaagcttaaatttcttgctatacagaaactatgtatgtatttaggctatttctgaagggcacagggaagggggaacaaatatcttcacttcagttttatttgtgaattacatgtttcatgaatccatttggcacagagacacaaggaagaaaacactagtaaccatctttccactagttcatatactgagaaacagtaaatacctttcctttccacttttaccctgtgttctttgaacatcatttgtgcagattctgccctcaatgaggaccaaataaagatgatttttgtgcttagcagtttaaggtatatggctgcatatgcaaaactctttcccaattcagtcgctacttttacttctgccctttctatccatcgtcttcattttgtgtgtacagtgctgtgtgtaagcttatcagtgtgtttttttatttgtatcagtcatgaaagtcctgttaggtatccagagttctatttatctagctgtacagactctttcagaggtttaacgtgctgcttccgatgtgccacctgcagtagtggatcatgtggagtgaaaggcaaatcttactgcttaatgtataaactctcaccacaggaagcatcgctgtttccaataaatattgctgaagacagaaaaaaaaaaaaaaaaaaa

SEQ ID NO: 474 - DNA, 2856 bp, Human
gcccgccgcccggcgacgcgcccgccggcgtccccggaggtgcccccggcccggccgggtcgtcgccccgccgccgcgcccgcgagccgctttgtctcgggcggggcgcgcgggagaggccgccaggtgccccccgccacgggcccgggccccccgccccggggcggcggcggcggcgccgggccccggggcggggggcgcgccgggatgggccccaagaggcgacagctgacgttccgggagaagtcacggatcatccaggaggtggaggagaatccggacctgcgcaagggcgagatcgcgcggcgcttcaacatcccgccgtccacgctgagcacgatcctgaagaacaagcgcgccatcctggcgtcggagcgcaagtacggggtggcctccacctgccgcaagaccaacaagctgtctccctacgacaagctcgagggcttgctcatcgcctggttccagcagatccgcgccgccggcctgccggtcaagggcatcatcctcaaggagaaggcgctgcgcatagccgaggagctgggcatggacgacttcaccgcctccaacggctggctggaccgcttccgccggcgccacggcgtggtgtcctgcagcggcgtggcccgcgcccgcgcgcgaaacgctgccccccgcaccccggcggcgcctgccagtccggccgcggtgccctcggagggcagtggcgggagcactactggttggcgcgctcgggaggagcagccgccgtcggtggccgagggctacgcctcgcaggacgtgttcagcgccaccgagaccagtctatggtacgacttcctgcccgaccaggccgcggggctgtgcggaggcgacggacggccgcgtcaagccacccagcgcctgagcgtcctgctatgcgccaatgccgacggcagcgagaagctgcccccgctggtggccggcaagtcggccaagccccgcgcaggccaagccggcctgccctgcgactacaccgccaactccaagggtggtgtcaccacccaggccctggccaagtacttgaaggccttggacacccgaatggctgcagagtctcgccgggtcctgctgttggccggccgcttggctgcccagtccttggacacctcgggcctgcggcatgtgcagctggccttcttccctcccggcaccgtgcatccgctggagaggggagtggtccagcaggtgaagggccactaccgccaggccatgctgctcaaggccatggccgcgctagagggccaggatccctcaggcctgcagctgggtctcacggaggccctgcactttgtggctgccgcctggcaggcagtggagccttcggacatagccgcctgctttcgtgaggctggctttgggggtggccctaatgccaccatcaccacttccctcaagagtgagggagaggaagaggaggaggaggaggaagaagaggaggaggaagagggtgaaggagaggaagaggaggaggaaggggaggaggaggaggaggaagggggggaaggagaggaattgggggaggaagaggaggtggaggaggagggtgatgttgatagtgatgaagaagaggaggaagatgaggagagctcctcggagggcttggaggctgaggactgggcccagggagtagtggaggccggtggcagcttcggggcttatggtgcccaggaggaagcccagtgccctactctgcatttcctggaaggtggggaggactctgattcagacagtgaggaagaggacgatgaggaagaggatgatgaagatgaagacgacgatgatgatgaggaggatggtgatgaggtgcctgtacccagctttggggaggccatggcttactttgccatggtcaagaggtacctgacctccttccccattgatgaccgcgtgcagagccacatcctccacttggaacacgatctggttcatgtgaccaggaagaaccacgccaggcaggcgggagttcgaggtcttggacatcaaagctgagtcactggacctagctgtgcccccaacctagattggcagcaccaccccagggcagaggactctctgggcacccgctgtgcatggagccagagtgcagagccccagatcctttagtaatgcttcccctggtcctgcaacaggcccggtcacctcggccgggcccggggctgaggtcagcctcactgcctgcttattgcctctttctcagaatcctctttcctccccatttggccctgggctcaggggaccaggtggggcgggtggggagctgtccggtgctaccacaccgtgccctcagtggactaaccacagcagcagccagggatgggccctggaggttcccggccggagagtgcctctcccctctgccatccacgtcaggtctttggtggggggaccccaaagccattctgggaagggctccagaagaaggtccagcctaggccccctgcaaggctggcagcccccacccccaccccccaggccgccttgagaagcacagtttaactcactgcgggctcctgagcctgcttctgcctgctttccacctccccagtccctttctctggccctgtccatgtgactttggcccttggttttctttccagattggaggtttccaagaggccccccaccgtggaagtaaccaagggcgcttccttgtgggcagctgcaggccccatgcctctcctccctctctggcagggccccatcctgggcagaggggcctggggctgggcccagagtccagccgtccagctgctcctttcccagtttgatttcaataaatctgtccactccccttttgtgggggtgaacgttttaacagccaaaaaaaaaaaaaaaaaa

SEQ ID NO: 475 - DNA, 3249 bp, Human
cgcggctgcatggacgcgggtccggcgcgcgggaggcgatgacggccccgccatggcccgggcgggcagctgcggcggcgccgcggcgggcgcagggcggccggagccctgggagctgtccctggaggaggtgctgaaggcctacgagcagccgctcaacgaggagcaggcgtgggccgtgtgcttccagggctgccgcgggctgcggggctcgccgggccggcgcctgcgggataccggggacctcctgctgcgcggggacggctcggtcggggcgcgggagcccgaggccgcggaacctgcaaccatggtcgtgccactagccagctcggaagcccagaccgtgcagtccctcggcttcgccatctaccgcgcgctggactgggggctggacgagagcgaggagcgcgaactcagccctcagctggagcggctcatcgacctcatggccaacaacgacagcgaggacagcggctgcggtgccgccgatgagggctacgggggtcccgaggaggaggaggaggccgagggcgtcccccgcagcgtgcgcacctttgcccaggccatgcggctgtgcgcggcgcggctgaccgacccccggggcgcacaggcgcattaccaggccgtgtgccgcgcgctcttcgtggagacgctggagctgcgggccttcctggccagggtccgggaggccaaggagatgctgcagaagcttcgggaggacgagccgcatctggagacgcctcgggcagagctggacagcctgggtcacacagactgggcccgactgtgggttcagctcatgcgggagctccgccgcggagtgaagctgaagaaggtgcaagagcaggagttcaaccccctccccaccgagttccagctcacgcccttcgagatgctgatgcaggacatccgggcccggaactacaagctgcgcaaggtcatggtggatggggacatcccgccccgggtgaagaaggacgctcacgagctcatcctggactttatccgctcacggcctccactgaagcaggtctctgagaggcggctgcgcccgttgccaccaaagcaaaggtccctgcatgagaagatcctggaggagatcaagcaggagcggaggctgcgcccggtgcggggcgagggctgggctgcccgcgggtttggctctctgccctgcatcctcaacgcctgctccggagatgccaagtccacctcctgcatcaacctgtcagtcacagatgctgggggcagcgcccagcgcccgcggccccgcgtgctgctcaaggcgcctaccttggctgaaatggaagagatgaatacatctgaggaagaagagtctccgtgtggggaggtgacgctgaaacgggaccgctccttctcagagcatgacctggcccagctccgaagtgaggtggcctctggcctgcagtcggccacccaccccccaggagggacggagccaccacggccccgagctggcagtgcgcatgtgtggaggcccggctcccgagaccagggtacctgtcccgcgagtgtctctgaccccagccaccccctactcagcaaccggggctcctcgggggacagacccgaggcctccatgacccccgatgccaaacacctgtggctggagttcagccaccccgtggagagcctggcgctgactgtggaagaggtgatggacgtgcgccgtgtgctggtgaaggccgagatggaaaagtttttgcagaacaaggagctcttcagcagtctgaagaaggggaagatttgctgctgctgccgggccaagttcccgctgttctcgtggccgcccagctgtctcttctgcaagagagccgtctgcacttcctgtagcataaagatgaagatgccttctaagaaatttggacacatccctgtctacacactgggctttgagagtcctcagagggtatcagctgccaaaaccgcgccaatccagagaagagacatctttcagtctctgcaagggccacagtggcagagcgtggaggaggcgttcccccacatctactcccacggctgtgtcctgaaggatgtctgcagtgagtgcaccagctttgtggcagacgtggtgcgttccagccgcaagagcgtggacgtcctcaacactacgccacgacgcagtcgccagacccaatccctctacatccctaacaccaggactcttgacttcaagtgacagccccaggtggccaggcctccaggaggcaccaggcaggccctgtatcaggctaggacgctctgagctgtgcatgtacatatatacatatatagatacatttataatatatacacacagtctatatatttatatacactgtttcctggccccagagctcatttgggttcaggcgcacttcaaaaccctccctgggggaggctgtttcttctcaggattccttgccagggaggaaggggagggaacagggtgggttttctcactgaagagagaaagcagaaggttctagatcctggcacagactgcatcccatgttcccatgctcttctccgtccccaggaatgcgaacggcagtttcccttccccagtggacgtctaggtggggacagggtatcttggctcccagctggaccagagtgccctgcttgcctctgctctccctttgtggggactcaggcagcagaggcatctgggaagtctctgagtaggcagggtcctcctgggaggcacccccacctgtttgaaaggtctggccaggcgtggtggttcaggcctgtaattccagcactttgggaggccgaggagggaggatcacctgaggtcaggagtttgagaccagcctggccaacatgatgaaatgttgtctctactgaaaatgcaaaaattagccaggtatagtggcaggaacctgtaatcccagctacaggggaggctgaggcaggagaatcgcttgaacccgggaggtgtaggttgcagtgagccgagattgcaccactgcactccagcctgggcgacagagcgagactctgtctcgaaaaaaaaaaaggtccgtgccaagctgctccctgcccttgccctttccctttccctggggtccaaaccacatgtgtcctgcctctcctggccctaccacattctggtgctgtcctcactcgcccctggcccagaggctcctgaagatgctgggcggtcctggcacagggaggagcagctctgtaaatctgtgcacatggccactcttggcctaataaaggaggtctcacagtcaaaaa

SEQ ID NO: 476 - DNA, 7907 bp, Human
tataaaagaggcggggcgcgcgcgtcgccgccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgccctgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagacacgcataactaaggaggccggcagtgtatctctgcgtatgaagcaggtggaagaactatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtctcatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccagctttccaagctgctgagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctggcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaaccggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccccaaagct

SEQ ID NO: 477 - DNA, 1719 bp, Human
gctccacctcgtccgtggccctgcccacccaggccgcaagagctgccgggacggtccccatcttcttggagcgctttaggctggccggcggcgctgggaggtggagtcgttgctgttgctgtttgtgagcctgtggcgcggcttctgtgggccggaaccttaaagatagccgcaatggctgaaaatggtgataatgaaaagatggctgccctggaggccaaaatctgtcatcaaattgagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaaggacgattactttgccaaaaaaaatgaagaaagaaaacaaaataaagtggaagctaaattaagagctaaacaggagcaagaagcaaaacaaaagttagaagaagatgctgaaatgaaatctctagaagaaaagattggatgcttgctgaaattttcgggtgatttagatgatcagacctgtagagaagatttacacatacttttctcaaatcatggtgaaataaaatggatagacttcgtcagaggagcaaaagaggggataattctatttaaagaaaaagccaaggaagcattgggtaaagccaaagatgcaaataatggtaacctacaattaaggaacaaagaagtgacttgggaagtactagaaggagaggtggaaaaagaagcactgaagaaaataatagaagaccaacaagaatccctaaacaaatggaagtcaaaaggtcgtagatttaaaggaaaaggaaagggtaataaagctgcccagcctgggtctggtaaaggaaaagtacagtttcagggcaagaaaacgaaatttgctagtgatgatgaacatgatgaacatgatgaaaatggtgcaactggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatactatatgaaaagagcaaaaaaaaaaaaaaa

SEQ ID NO: 478 - DNA, 1777 bp, Human
ggttgacggaagtgctctatcttgttgccggaagtgggaagagagaaaggttgtgatggcggctatagctgcatccgaggtgctggtggacagcgcggaggaggggtccctcgctgcggcggcggagctggccgctcagaagcgcgaacagagactgcgcaaattccgggagctgcacctgatgcggaatgaagctcgtaaattaaatcaccaggaagttgtggaagaagataaaagactaaaattacctgcaaattgggaagccaaaaaagctcgtttggagtgggaactaaaggaagaggaaaagaaaaaggaatgtgcggcaagaggagaagactatgagaaagtgaagttgctggagatcagtgcagaagatgcagaaagatgggagaggaaaaagaagaggaaaaaccctgatctgggattttcagattatgctgctgcccagttacgccagtatcatcggttgaccaagcagatcaaacctgacatggaaacatatgagagactgagagaaaaacatggagaagagtttttcccaacatccaatagtcttcttcatggaacacatgtgccttccacagaggaaattgacaggatggtcatagatctggaaaaacagattgaaaaacgagacaaatatagccggagacgtccttataatgatgatgcagatatcgactacattaatgaaaggaatgccaaattcaacaagaaagctgaaagattctatgggaaatacacagctgaaattaaacagaatttggaaagaggaacagctgtctaatcccttcaagaactgtttatagaagcttgagaatggggtaaaaatttctgctagcaaaatcaagttctttttgaaattttatcagtaatccagaatttagtagtccatgccttctcactcagcatttagaaataaaaatgtggtttcttaaacgtatatcctttcatgtatatttccacatttttgtgcttggatataagatgtatttcttgtagtgaagttgttttgtaatctactttgtatacattctaattatattatttttctatgtattttaaatgtatatggctgtttaatctttgaagcattttgggcttaagattgccagcagcacacatcagatgcagtcattgttgctatcagtgtggaatttgatagagtctagactcgggccacttggagttgtgtactccaaagctaaggacagtgatgaggaagatggcagtggccaccggaggactggagcagtccctcctcatggcggcctgtgaccaaggtcggggaggagtggagctatccttccatgatctgatcatgtacagttccctttttaaaaagcaataaatgcttgggattagaatttctaacatttttagtctatcatttaaaacaaacatttgtatatatacatttgtttatatacatacatgcttccattctacaaacactgaaagaatattttattatgggaaattccatacacccaatacccctggtgagtcccatatacccagtaccctgttcaacaatcattaactcatggccagtcctgcttcatctttatttccatttactttcttcatgactcttattttgacgcatatactagatatataatttcatctataattattttagtatgtatctctgaaagataaagacttaaatgaccacaatactattatcactgcaatagatttatttttataaaactccagagggaaaggttgttattttttctctatgttgaattaaatgctaaatatctaa

SEQ ID NO: 479 - DNA, 1199 bp, Human
cccaggaaagcttgaaggcagagatagactcacgtctctaagacatatacataatatagccgcaaccgcggcggccttactttcccggagctgcatccccttttaggcgaagagcggaggcgaccagggactaccctaggtgaaagggcagccacctggccctacccgggctcaacgccgagcctctcggaggtacggcctcccggggaccttccagactggtcggcgcaagcgaagggcggggaccaccgaaggagtgtgtgacttaggcatccagcgcactgcctgacccgaagtaccgacccgagttatgcccaccctccaactttgcgacggaaatgtgtcatcgaaagccaggtacaccaggggttggaaaaaccacactaggcaaagaacttgcgtcaaaatcaggactgaaatacattaatgtgggtgatttagctcgagaagagcaattgtatgatggctatgatgaagagtatgactgtcccattttagatgaagacagagtagttgatgagttagataaccaaatgagagaaggtggagttattgttgattaccatggttgtgatttcttccctgaacgctggtttcatatagtttttgtgctgagaacagataccaatgtattgtacgaaagacttgaaacaaggggttataatgagaagaaactaacagacaatattcagtgtgagatttttcaagttctttatgaagaagccacagcatcctacaaggaagaaatcgtgcatcagctgcccagtaataaaccagaagagctagaaaataatgtagatcagatcttgaaatggattgagcagtggatcaaagatcataactcttgacttataaggctagctacttaataatcactcttgttgatatctctgccgacatcatagaaattgttcaagtgtcagtaacactttattaaaatcatgttgcagaaccagcaggtggatagtatataggtttatgcctgtgtttctttttctccatgagaaagctaaacatgaaatataatgaatatagtattattaaggattgagacaaaaactgtgattttaatacttaaattgctaaagaataaataaatctgacaaaatgggtggatatcttttaagtttattacagaaaaaaatgcagatgatctcttaaaataaaactaaagataaagcaaaaaaaaaaaaaaaaaa

SEQ ID NO: 480 - DNA, 2829 bp, Human
gcggggaagtggcggctgaagcgccgccggcggggctcactgtggtggtgtgagtgggaggcggcggcgctggtggctgcagctggggtgaggcgcgaggcggcgcactcgacggctgactggagcagcggatataagtcaaagagtacagcagaaaatgtctactgaacggacttcttggacaagcctgtccaccattcagaaaatagccctgggccttgggatcccagccagtgcaacagttgcctatatcctataccgcaggtatagggaaagcagagaagagcggctgacatttgttggggaagatgacattgagatagagatgcgggttccccaggaggctgtgaaactcatcattggccggcaaggagccaatattaaacagctgcggaaacagacaggtgctcggattgatgtggacacagaggatgtaggcgatgagcgagtgctgcttatcagtggttttcctgttcaggtgtgcaaggccaaagcagcaatccatcagatcctgacagagaataccccagtgtctgagcagctttcagttccccagagatctgtgggcagaatcatagggagaggcggcgagacaattcgttctatctgtaaggcatctggagccaaaattacctgtgacaaagaatcagaagggacattactactatcaagacttataaaaatctcaggaacacagaaggaagtggcagcagccaagcatttgatactggagaaagtttcagaagatgaagaacttcggaagagaattgctcattctgcagaaaccagggtcccacgcaaacagccaatcagtgtgagaagagaagacatgacagagccaggtggagctggagagccagcattatggaaaaacaccagttctagcatggagccgactgcacccctggtgactcctccacccaaaggaggaggcgacatggctgtggtagtgtcaaaggaaggttcctgggagaaacctagtgatgacagctttcagaagtctgaagcccaggccatcccagagatgcccatgtttgaaatccccagtcctgacttcagttttcatgctgatgagtacctagaagtctacgtttctgcttctgagcaccctaaccacttctggatccagatcgttggctcccgcagcctgcaattggataagcttgtcaatgagatgacccagcactatgagaatagtgtgcctgaagacttgactgtgcatgtaggagacattgtagcagcacctttacctacaaatggttcctggtatcgagcccgggtcctcggcaccttggagaatgggaacttggacctctattttgttgactttggagataatggagattgcccactgaaggacctcagggctctcaggagtgacttcctaagccttccatttcaagcaatagaatgtagtctggcacggattgctccctcaggtgaccagtgggaagaggaagctttggatgagtttgatagactcactcattgtgctgactggaagcctctggtagccaagatctctagctatgtccagactgggatctcaacttggccaaagatctacttatatgatactagcaatgggaagaaacttgatattgggctagaattagtacacaaaggatacgcaattgagcttcctgaagacatagaagaaaacagagctgtcccagacatgttgaaggacatggccacagaaacagatgcctctctcagcacgttgctcactgagaccaaaaagagctctggagagataacacataccctgtcctgcctcagcttatcagaagctgcttccatgtctggtgatgataaccttgaagatgactacttactctgaagtctgggcttcagtttgctcagccatctgctttgctgtgtgagtgcagctatcatctatctgtagcaacaggaaagtaatgagggcgacagtggggcacttgctttgattccctctttcccatgccctgtcttaatatacttctctgcagctgctttcctgcagcttaacttgctctcagattgagcactttcaagctttttgtgtatttctgtctttggcaggatttggcataggaattggtgcatggaggagaggagtgtatgataaaggatccatgcagtccttcctttattacacatatagtctggcttgctgtggaccaaattaatattctcctcccatcagactacaaaaaaattggactaccacgctacaagtgtgtctcccccattccacctccggatccctccccaaccctccagtgtttgaatactgctgtgttacttccaggccgttcaacgtcaggctcagtcccctctaccagtcatgattcacattactactaggctgtatcctttttgaggctgggaaacagtcaggctttcgtcattggaagtgattctgcagacttctgactcaccttatcaggtgactctggttaaggaaagcttttgagtggtgaactcaaagactccagttgaatcaggaggcaaaggcaaaaattagcataattatatttaaaagcctcaggaagtgggaagagaatactgcctcccagcctcaattgctgatatgttattggagacaggcttttgaaactgctccagctatttctctgtaacctttagttaaaatataagtagaaaggagacaggaggctcaggaaattttctaaattgctagtataatatctatatgtatacacacatatacacccgtggagagagaggaagagtatacagtcctgtttgaatcatttggaggatttttttgctgaataaagttctcaagaaaattttctaaaaccaaaaaaaaaaaaaaaa

SEQ ID NO: 481 - DNA, 1500 bp, Human
gctattagtcgtcatcgacggaagtgcacctgactgagcggaagtaggagctctcagaggctaagaaggtggagaccggagaagctgtgaggttctttagcgtcacctccctcactgggcagcatgggggagaagtcagagaactgtggggttccagaggatctgttaaatggtttgaaggttacagatactcaggaagccgagtgtgctggccctccagttcctgatcccaaaaatcagcattcccagagtaagctgctcagggatgatgaggcccatctccaggaggaccagggagaagaggagtgttttcatgactgcagtgcctcatttgaggaggagccaggagcggacaaggttgagaacaaatctaatgaagatgtgaattcctctgaactagatgaagaatacctaatagaactggaaaaaaacatgtcggatgaagagaaacagaaaagaagagaagagagcactagactaaaggaggagggaaatgaacagtttaagaaaggagattatatagaagctgaaagttcttatagtcgagccctcgaaatgtgcccatcctgcttccaaaaggagaggtcgattctattttcaaatagagctgcagcaaggatgaaacaggacaagaaagaaatggccatcaatgactgcagcaaagcaattcaattaaaccccagctatatcagggcaatattgaggagagcagagttgtatgagaagacggacaagctagatgaagccctggaagactataaatctatattagaaaaagatccatcaatacatcaagcaagagaagcttgtatgagattacctaagcaaattgaagaacgtaatgaaagactaaaagaagagatgttaggtaaattaaaagatcttgggaacttggttctccgaccttttgggctctccacggaaaatttccagatcaaacaggattcctctaccggctcgtactccatcaatttcgttcaaaatccaaataataacagataacaaagataacaaaagctttacaagctgacttggaattgtgtgctgcttgctgttagctaggggaaaggccctgccaatgtttaacttttaaaagcatcttatctaaaagaaaggctatccagtagagcccagtgctcccttgtccctcttttatgatcagggtgaaatgtacttcctgatgtaatgaacctaatttgatttccattttaaggtggtgtctgtgcagctggtgtccccgattctggctgtcctatgtccaggaagaagcccatttgttgaggctgaccttcctgatcatacacacacacagcccagcaaaagcctctcctgaaccaaacaaacctgttggttgggagactgcccagacatgattgatgacgggttcccgcctgctgtcccctccctgatcacacagctaacgaggctgcctccagcatttcctgatttcctctgtggtaataaaagctttctgtgcttaggaaaaaaaaaaaaaaaaaa

SEQ ID NO: 482 - DNA, 11795 bp, Human
gggggcgcgcgcgcggtttgggggcagtgaggggcgccgcggcggcgcgcagcacggcgggaacatggcgcgcggaaccggcgcgcgcgcctagctggcgggaccgttagctcgaggcggacgcggcccgggccccgtggggatggagcagtcgccgccgccggcgcccgagccgacccaagggccgacccccgcaaggagccgaaggcggcgggagccagagtcgccgccggcgtcggcgccgattcctctctttggtgctgacactattggccagagaagtcctgatggaccggtactgagcaaagctgaatttgttgagaaagttcgtcagagtaatcaggcctgtcatgatggagatttccacacagctattgttctgtataatgaagccctggctgttgaccctcagaactgcatcttatacagcaatagatctgcagcctacatgaaaatccagcagtatgacaaggcactggatgatgcaatcaaagctcgacttctcaatcccaagtggccaaaggcatacttccgacagggtgttgccctccagtaccttggacgtcatgccgatgccctggcagcctttgcatctggactggctcaagaccccaagagtctccagcttctggtggggatggtggaagccgccatgaaatctcccatgagagactccctcgagcccacttatcagcagcttcagaaaatgaaactggacaagagtccctttgtggtcgtgtctgtggttgggcaggaactcctgacagctggccatcatggggcctctgtggttgtcttagaagccgcactgaagattggcacctgcagcctcaaactgagaggttctgttttctctgccctgagcagtgcttactggtctcttggaaatacagagaagagcaccggatatatgcagcaggacttggatgtagccaagaccttaggtgaccagacaggagaatgccgagctcatgggaatctgggctctgcattcttctccaaaggaaattaccgggaggctctcactaaccacaggcatcagttggtactcgccatgaaactcaaagatcgagaggcagcttcatcagccttgagcagtctgggccacgtgtacacagccattggagactaccccaatgcactggccagtcacaaacagtgtgttcttcttgccaagcaatccaaagatgaactttctgaagcccgagaacttggcaacatgggagctgtgtatattgccatgggtgactttgagaatgctgtgcagtgccatgagcagcatctgaagatagccaaggacctggggaacaagcgagaagaggcccgggcttatagcaacctgggcagtgcctatcactaccggaggaactttgacaaggccatgtcttaccataactatgtcctggagctggcacaggagttgatggagaaggctattgagatgcgggcctatgctggactaggccatgctgccaggtgcatgcaggatttggagagagctaaacaataccatgagcagcagctgggcattgctgaggatctcaaggaccgggctgcagaggggcgagcatcctccaatctaggaatcatacaccagatgaaaggtgattatgacactgcactgaaactccacaagacccacctgtgcattgcccaggagctgagtgattatgctgcccagggccgtgcctatgggaatatgggcaatgcctacaatgccctgggcatgtacgaccaggcggtcaaataccatcggcaggagctgcagatctccatggaagtgaatgaccgcgcctcacaggcctccacacatgggaaccttgccgtggcctaccaggccctgggtgcccatgaccgggccctgcaacactatcagaaccacttgaacatcgcccgggagctacgagacatccagagcgaggcccgggccctcagcaacctgggcaatttccactgctctcggggagagtatgtccaggctgccccctattatgaacagtacctccggcttgctcccgaccttcaagacatggaaggagaagggaaggtctgccacaatcttggctatgcccattactgccttggaaactatcaggaggcagtgaagtactacgaacaggatctggcactggctaaagaccttcacgacaagttgagccaagcaaaagcctactgcaacttgggcctagcattcaaggctctgctgaatttcagtaaagctgaagagtgtcagaagtacctactgtccctagcccagtctctgaataattcccaggctaaatttcgagccctaggaaacctgggcgatatattcatctgtaaaaaagatataaatggtgcaataaaattctatgagcagcaactgggcttagctcaccaggtaaaggacagaagattagaagccagtgcatatgcagccctgggcactgcataccgaatgatccagaagtatgacaaggccctgggttatcacacacaggaactggaggtatatcaggagctgagtgacttgccaggggagtgcagagctcatgggcacctggctgctgtctacatggcccttgggaaatacacaatggcattcaagtgttatgaagagcaactggatctagggcaaaagctgaaggatccgagtctggaagcccaggtctatggcaacatgggcatcacaaagatgaacatgaatgtgatggaagaagccattggctactttgagcagcaattggccatgctgcagcagctaagtggaaatgagtctgtgctcgacaggggccgggcctatggcaacctgggggattgctacgaagccctgggtgactatgaggaagctatcaaatactatgaacaatatttatctgtcgcgcagagtctgaatcgcatgcaagaccaagccaaggcttaccggggcctgggaaatggacacagggcaatggggagcttgcagcaagcccttgtgtgctttgaaaagaggctcgtggttgctcatgaacttggagaggccttcaataaagcccaggcctatggagagctgggaagtctgcacagccaattagggaattacgaacaagccatttcctgccttgaacgccagctgaacattgctagagatatgaaagaccgagccctggagagtgacgcagcctgtggcctggggggcgtttaccagcagatgggggagtatgacacagccctgcagtaccaccagcttgatctacagatagcagaggaaaccaacaaccccacgtgccagggccgagcctatgggaacctgggcctgacttatgaatccctgggcaccttcgagagggctgtggtctatcaagaacagcacttgagcattgctgcacagatgaatgacttggcggccaagacggtgtcatatagtagccttggaaggacccatcatgccttgcagaactattcccaagcagtcatgtacttacaggaaggtttaaggttagctgagcaactgggccgaagagaagatgaggcaaaaattcgccatggccttggcctctccctttgggctagtggaaacttggaggaggcccaacaccagctttatagggcatcagccttgtttgaaacaatccgacatgaggcacagctgagcacggactacaaactctccctctttgacctgcagacatcatcctaccaggccttgcagcgggtgctcgtcagcctaggccatcatgatgaagccctggctgtggcagaaaggggacggacaagggcatttgctgatcttctggtggaacgacaaacaggacaacaagactccgacccctactccccagtcactattgatcagatcttagagatggtaaatggccagaggggactagtgctttactattccctggctgcaggctatctgtatagctggctgctggctcctggggcaggaattgtgaagtttcatgaacactacctgggtgagaacacagtggaaaactcaagtgacttccaggccagcagcagtgtaacccttccaacagcaaccggctcagccctggagcagcacattgccagtgtccgggaggccctgggggtggagtctcactactcaagggcctgtgccagcagtgagacagagagtgaagcgggagacatcatggaccagcaatttgaagagatgaacaacaaactcaactcggtcactgaccccactggctttctgcggatggttcgccgcaataacctgtttaacaggagctgccagagcatgacgagcctgttcagtaacactgtgtcaccgacccaggacgggacctcctctcttcccaggaggcagagctcgtttgccaagcccccgctccgtgccctgtatgacctgctcatcgcgcccatggaagggggcctgatgcactccagcggccccgtgggccggcaccggcagctcatcctggttctggagggggagctctacctcattcctttcgccctcctgaagggaagctcctccaatgagtacctctacgagcgcttcggcctccttgctgtcccttccatccgctccctcagcgtgcagtccaagtctcacttacggaagaacccgcccacatactccagctccacatccatggcggctgtcatcggcaaccccaagctaccatcggccgtgatggacaggtggctgtgggggcccatgccatcggccgaggaagaggcctacatggtgtccgagctgctgggctgccagcccctagtgggcagtgtggccaccaaggagagggtcatgagtgccctgacccaggctgaatgcgtccactttgccacccacatctcctggaagctgtcggccttggtcctcacgcccagcatggacggcaaccctgccagcagcaagagctccttcggccacccctacacgatccctgagtccttgcgggtgcaggacgatgccagtgatggggagagcatctcggactgcccgcccctgcaggagctgctgcttactgccgccgacgtcctggacctgcagctgcctgtgaagctggtggtgcttggctcctcccaggagtccaacagcaaagtcacagccgacggggtcatcgcgctgacaagggccttcctggctgccggcgctcagtgtgtcctcgtgtctctgtggcctgtgccagtggctgcttctaagatgttcatccatgccttctactcatccctgctgaacggcctgaaagccagcgccgccctgggggaggccatgaaggtggtgcagagcagcaaggccttctcgcacccctccaactgggcagggttcatgctcatcgggagtgacgttaagctgaacagcccctcatcactcatcggccaggccctcacagagatcctgcagcacccggagcgtgcgcgggacgccctgcgagtgctgctgcacctggtggagaaatccctgcagcgcatccagaatgggcagcgcaatgccatgtacacatcccagcagagtgtggagaacaaagtgggcggcatccctggctggcaggccctcctcaccgctgtgggcttccggctggaccccccaaccagtggcctgccagcggctgtcttcttcccaacctccgacccgggcgaccggctccagcagtgcagcagcacactccagtccctgctgggtctgcccaatcctgccctccaagccctttgcaaactcatcactgcctccgagacgggcgagcagctcatcagccgggctgttaaaaatatggttggaatgctccaccaggtgctggttcagctccaggctggcgagaaggagcaggacttggcatcagctcccattcaggtctccatcagcgtccagctgtggcggctcccgggatgccacgagttcctggcagctctaggttttgatctctgtgaagttggtcaggaggaagtaatcctgaaaaccgggaagcaagctaatcgacggactgtgcacttcgcgctccagtccctgctgtctctgtttgattctactgagctacccaagcgcctcagccttgacagctcctcctccctcgagtctcttgcttctgctcagtctgtttccaacgccctgcccttgggttaccagcaaccccccttctctcccaccggtgcggacagcatcgcctcagatgccatctctgtgtacagtctgagctccattgcctcctcaatgagctttgtctccaaacccgagggtggatcagagggtggaggccccggaggacggcaggaccatgaccggtccaagaacgcttacctgcagagatccaccctgcctaggagccagctgcctccccagacccgccctgcaggcaacaaagatgaagaagaatatgaagggttttctatcatcagtaacgagcccttggcgacctaccaagaaaaccgaaacacatgcttctcaccagaccacaaacaaccccaacctgggacagccggaggcatgagagtctcggtgagctccaaagggagcatcagcactccaaattctccagtgaaaatgactctgattcccagccccaactcacccttccaaaaggtgggaaaactagcaagctcagatacaggagaatcagaccagtctagcacagaaacggacagtaccgtgaaatcccaagaagaaagcaacccaaaactggatccacaagagttagcccagaaaattctggaggagacacagagtcatctcattgcggtggagcgtcttcagaggagcggcggccaggtgagcaagagtaataaccctgaagacggcgttcaggcgcccagcagcactgctgtcttcagagcgtcagaaaccagtgcgttcagcaggcctgttctctcccatcagaagagtcagccatcaccagtcactgttaaaccaaagcccccagccaggagctcctccctgcccaaggtgagttccggatatagcagccccaccacctcagagatgtccatcaaagacagcccgagccagcacagtggccggccatcgcccggctgcgactcacagacttcccagctggaccagcctctctttaaactgaagtaccccagctctccttacagcgctcacatttccaaatcaccaaggaacatgtccccaagctccggccaccagtctcctgctggcagtgcaccctccccagctctctcctactcctcagctggatctgctcgctcaagtccagcagacgctcccgacatagacaaactgaaaatggcagccattgatgaaaaggtgcaggctgtccataacctgaagatgttctggcagagcacaccccagcattccacagggccaatgaagatcttccggggggctcctggcacgatgacttccaaaagggatgtcctcagtctgttgaatttgtcaccacggcacaataagaaggaggagggagtggataagcttgaactgaaggagctgtccctgcagcagcatgacggagctccaccgaaagcccctcccaacggacactggcgcaccgagaccacctcgctgggctcactgccgctgcccgccggccctcccgccacagcccccgcgcgccctttgaggcttccttctggaaatggctacaagttcctgtctccaggaagatttttcccttcttccaaatgctaaagcatcttttatacccactgactctgagcagcctgcagatgggggcctggcgtttgcttcagcccttccctgagtgcagtccccccacagccaccagcaccctcatgatgctgtgctctgcaggcgaggggcaccaccacgtccaaaggctgccacacacactggtggcttttctgggccacattcaccaaaagccaggacttctgtggggctggtacaggaggctcatggaatttcctacacacttcaccaaatgtttgtttacctttgaactccctgcttctcatctttgatatgattcttcaccaggattttgtacaaaaatgatcatggttctggggtggggagaggaaagggagcacatattttgctaagaggtatatatgcagtaccttttatacacagaaatacaaatagagctttttctaaggctttcggttgctggttgggggtgggatatatgaaatttcagttgaattctacaggaaagtgttatattagccaaaaacagaaaaatggtttttaaaatgccaatgatttgtaattaaattgtagcaattttggtctcatgatagtgtaatatctcagcaacaatgcaataattcacattgaaacagcgcttccattctgaactctgctctgcaaatgtcttttgggtcccgctgtcaaccaaacttgaattttcttaaaaaaaaaattatgtaactcttatccaggcattttagaactatgcaattgtgatttaaaatgcaactttgtgcttttaaaacattattgaccttttttgtatatggataaacaacttggttttattatcaatagtactttgcatttatagctattatttttaaaagctcaaaaagttttttaaaatgtcaaattttgaatagtcatcaataagtaattatcaagtttggaaggaaaggttgaaatgactccgtttccttataagcaaaaaaaaaaaaaaaaaaaaaaaaaaaaaaaaaaaaatttccatggctaactagatttaaccagaatcccgccttccaggctcctgttcccttttattagctgctgaattttattcccttttcccaactccaggtccctcagttgtcttatatctaaatcctttgccaggtccccacaatcccagcacctgcctctgtgagctgcccccaggccctcaccttggccctggccagcctcctgtgctcctgctgtctgaaggactggcccctcccccactgctgaagccacacgtacagatcctaagcaacagggccttttgctgggacgtatgcctggattatggccaaccgggaagagagagatgtatcttaaaaagtggaggtggacttctcctacagctctgacggtaacttaaattgttgccagcttgaggcaagacaagggaatcatctagttaggggtaaccattaatttattttataaagaaaggaaatgctgaaagtcgtattagtactgagtttagttggagaatttagataagtaagtatcttttaggtaattctaaaattaaaatcctacccacctcactacagggttcctcatgaaggtgggcggccacctggcctgggccaccagcagcacatggagcagacctgaggggcctggcagggggcactgacctcaggatccccaggtgggggttttaaccatgggtgggatctcagcttctgcgcatacactgacaatctcacctgttcctcagtgtactcctctgaaaagaagaaaggataatatttatccaatctgtgttctcctgagctccatcctaggggtttttaatttaaccaacagccatgttgacaaaagccaacaataagcatgtcttattctagccctgatcccaacactgaaagcgaagtactttataaagaagccagcaattatgagggtttctttatgttagtaggggaaaaaatggtaataaaagtaccagtgtagcaagtgaagaccaaatttatagcactgtgcattagatagcaaaatcaggttcttaacaatgaaaagtaaacctcaagtttctaaatccatatgcagatggttaggctgtccctctcttagcaaatctctcagcctccttctttcccaagtgccaaggatccctggagtaaagctctggggtctgtgctctctttctgtgaggggaaggctgcggccctatttgcccctctctagcaaacacccccaccaccctgccgcttcctgtggttattgagccagctaggagttactcatggactctaacctggttttagtcccatgtacatcgttgttttaggtttcatactgaagagccaatggtttatgtggttttattctgtcttaaatataagtttcaaggaagggaaaacaaaagtgataaaatgatagaacagtctagaggccactgtaaagtcaccgccactttacgtgtatgtcagtcttggtgttcttgtatgagtaaaatggatgtaaaatcataaaatcacagtgaatgtttcaggctacactggaaaaagtatgcacttagaattaaaggaaattgtataattcaccaagatttctttgtgtagatcaggggttggcaactatgacccacaggctaagactggtcagcggtctggtttttcacagccatgagctaagttacctttttaaagggttatataagtaattacatcatatttttgattttgcctttggcccacaccacataaaatattcaatacctggcctttttttttttttttgagacagagtctcgctctgtcacccaggatagagtgcactggtgcgattttggctcactgcaacctcttcctcctgggttcaagcaattctccctgcctcagcctctaagtagctgggactacaggcacccactaccatgccttgctaatttttgtatttttaatagagatggggtttcaccatgttggccaggctggtctcgaactcctgacctcaggggatccgcccgccttggcctcccaaactgctgggattacaggtgagccactgcgcccagccaatacctggccttttaagaagtttgctgactcctggtatggatgacagaaaatggaataacgttttgtttctccagtctaggaaaagcaagtcaggtagtggatagactgactggcgtccggggagcccagggtatgtgagggccacgtggatggaagcaaatgcctcctgcatagcccttggctctttgtcccacttgggaggagtccatggatgtaatatttacaaaacaattttttccttaccatttgcagaaagcattgcatatatttccttttagctcaggaaactggcatgccccaccctctgctactccatcagatgtaaatacaatgactataagccgtacaactcccctctcttagaaacctcagcaggaccacagagcaagggagtcaaagctttcttaattctctccagtaaatgactcaactaatttgatttttttaattaagtcaaaatatcaagagaaaaattgctactaaaacttacattttgatccacactgatgtgcaacacaaaatgaaagttttcacctccattccattttttaaaaattcacggtccacactgaaacttgctgggttttagcaggagacaaaggtgtcacccacgctgtcctcatcctgctctctctgtcccagtgacgctccagcatatgatcactgcagccggtccctggcccgtgccgattctgccacctcccagccacacacatttgcagacccacaagaagaactgtagccttgataatttcagttcaggctggaaaaatgccatgcaataatctggtttgctttcagtaagtaggcaacaagtgaaaactgtataattttcatcacctattctgctgttctatctaaaatgagtgtacctgtggtttgtgaactgggcccttgtttgtgccagatccttcaaagatgttccctgtcaggacacctgtggccctgcccctcctcagacaccttcccactggcattcacgttccttatatgcagtgttagccatctttggcctacgtggactttttttgtaaattacaccatttccagacattaaactttttatattatgaaatttaccatgtaaaaagaacttcatatttttattgagattgctaaggcacttggccttcctcctttgtgattttcagtgtctattaaagcatgagttccctcagttttaa

SEQ ID NO: 483 - DNA, 1659 bp, Human
gctgggggcgggtcctgcggcaccgcccgggaagctgcgcgagggtcgacagcctccgccacatcctccacctctcttggtccagcgagcgttgccgggccagggtcaagcggagggctccgacggcgcggacggagcgaagcgccgagccatggcgcaccaaacgggcatccacgccacggaagagctgaaggaattctttgccaaggcacgggctggctctgtgcggctcatcaaggttgtgattgaggacgagcagctcgtgctgggtgcctcgcaggagccagtaggccgctgggatcaggactatgacagggccgtgctgccactgctggacgcccagcagccctgctacctgctctaccgcctcgactcacagaatgctcagggcttcgaatggctcttcctcgcctggtcgcctgataactcccccgtgcggctgaagatgctgtacgcggccacgcgggccacagtgaaaaaggagtttggaggtggccacatcaaggatgagctcttcgggactgtgaaggatgacctctcttttgctgggtaccagaaacacctgtcgtcctgtgcggcacctgccccgctgacctcggctgagagagagctccagcagatccgcattaacgaggtgaagacagagatcagtgtggaaagcaagcaccagaccctgcagggcctcgccttccccctgcagcctgaggcccagcgggcactccagcagctcaagcagaaaatggtcaactacatccagatgaagctggacctagagcgggaaaccattgagctggtgcacacagagcccacggatgtggcccagctgccctcccgggtgccccgagatgctgcccgctaccacttcttcctctacaagcacacccatgagggcgacccccttgagtctgtagtgttcatctactccatgccggggtacaagtgcagcatcaaggagcgaatgctctactccagctgcaagagccgcctcctcgactccgtggagcaggacttccatctggagatcgccaagaaaattgagattggcgatggggcagagctgacggcagagttcctctacgacgaggtgcaccccaagcaacacgccttcaagcaggccttcgccaagcccaagggcccagggggcaagcggggccataagcgcctcatccgcggcccgggtgaaaatggggatgacagctaggaggctggagcagggccggccacgtgtggactgtggggctgcccaccttccgctccctgccaccatcctccttcctgggctccaggaaagtgtttctgggaggtcaggagggctggcagctgaacgcacttgcagcgtccgagggccaccgggctggcattttgtgacccttccctgttgctgtccctgcatctcgtctgtgtgcccagggtgtccggggaccctgcctggctggcttaagggggctgggtcaggggcctggcatgaacctggcctcccggggagctgagactagggtcccagcacagcccagaaacctttggccacaagaagtggggtcagtcagggctggggcaggggtcactgcagtttgggatggttgaatgctgtattttctaaagaataaaatatttttaaatcaagaaaaaaaaaaaaaaaaaaaaaaaaaaaaaaaaaaa

SEQ ID NO: 484 - DNA, 4299 bp, Human
gtgacgcgaggtcacgtgacgggttgggcagcctgtgccgccgccgccgctttgtaagaggcacattggcagattttctattttgtacatacattattttgtatatactgtatatgatgacttcagtgagcagtgaccattgtcgaggtgctcgggaaaaaccacagatttcagcagcacaatcaacgcaaccacagaaacaagtggtacaggcaacagctgaacagatgcgtctcgctcaagtgatctttgataagaatgattcagattttgaagctaaagttaagcagcttatggaagtgacagggaaaaatcaggatgaatgcatagtggccctacatgattgtaatggagatgtgaacaaagctatcaatatattgctggaagggaattcagacacaacttcatgggagactgtagggtgtaagaaaaagaattttgcaaaagaaaattcagaaaacaaagagaatagagagaagaaaagcgagaaagaatcgagtcgtggacgtggaaacaacaaccggaaaggaagaggcggcaatcgtggcagagaatttagaggtgaagaaaatggaattgattgcaatcaagtggacaaaccttcagatcgtggcaagcgagcccggggtagaggatttggacgtggcagagggagaggggcaggaaggttctcaacccaaggcatggggacatttaatcctgcagactattcagattctacatctacagatgtgtgtgggacaaagctagtagtttgggaagctgctcagaatggtgcagatgagggaactgaactggcatcaaatactcacaacatagctcaggatctgtcaaacaaaagttcttatggactcaaaggggcttggaagaattctgtggaagagtggacaacagaagactggactgaagatctttctgaaacaaaggtcttcactgcctcatctgctccagcagagaatcacatcttacctgggcaaagcattgatctggtagccttgctccagaagcctgttcctcacagtcaagcctcagaagccaactcctttgaaacttcccaacagcagggctttggccaagcccttgtcttcacaaattcgcaacacaacaatcagatggcaccagggactggcagctccactgccgtcaactcctgttctcctcagagcctgtcatccgtccttggctcaggatttggagagcttgcaccaccaaaaatggcaaacatcaccagctcccagattttggaccagttgaaagctccgagtttgggccagtttaccaccaccccaagtacacagcagaatagtacaagtcaccctacaactactacttcttgggacctcaagcccccaacatcccagtcctcagtcctcagtcatcttgacttcaaatctcaacctgagccatccccagttcttagccagttgagccagcgacaacagcaccagagccaggcagtcactgttcctcctcctggtttggagtcctttccttcccaggcaaaacttcgagaatcaacacctggagacagtccctccactgtgaacaagcttttgcagcttcccagcacgaccattgaaaatatctctgtgtctgtccaccagccacagcccaaacacatcaaacttgctaagcggcggatacccccagcttctaagatcccagcttctgcagtggaaatgcctggttcagcagatgtcacaggattaaatgtgcagtttggggctctggaatttgggtcagaaccttctctctctgaatttggatcagctccaagcagtgaaaatagtaatcagattcccatcagcttgtattcgaagtctttaagtgagcctttgaatacatctttatcaatgaccagtgcagtacagaactccacatatacaacttccgtcattacctcctgcagtctgacaagctcatcactgaattctgctagtccagtagcaatgtcttcctcttatgaccagagttctgtgcataacaggatcccataccaaagccctgtgagttcatcagagtcagctccaggaaccatcatgaatggacatggtggtggtcgaagtcagcagacactagacactccaaagacaacaggccctccctctgccctcccgtctgtgagctccctgcccagcaccacctcctgcactgcacttctgccgtccacatcccagcacactggcgacctgactagcagccctctctctcagcttagcagttcgctctccagccaccagagcagcctctctgcacatgcagccctctcctcgagcacgtcacacacacatgccagtgtggagagcgcctcttcccaccagtcctcagccaccttctccacggcagcgacctccgtctcaagttccgcatcctcaggcgtcagcctgtccagtagcatgaacaccgcgaacagcctctgtctgggtgggacccccgcgagtgcatccagcagcagtagcagggccgcgcccttggtgacctcaggcaaagcacccccaaacttacctcagggggtgcctcccctgctgcacaaccagtacctcgtaggtcccggaggactgcttcctgcctacccgatctatggctatgacgagctccagatgctgcagtcacggctgccagtggactactatggaattccctttgctgcacccacagcgcttgccagccgagatgggagcctagctaataatccatatccaggtgatgtcacaaagtttggccgtggggactctgcatcccctgcacccgctaccacaccagctcagccacagcagagccaatcacagacccaccacacagcccagcagcccttcgtgaatcctgcactgccacctggctatagctacactggtcttccctactacacaggcatgcccagtgccttccagtatggccccaccatgtttgtccctccagcctcagccaagcaacatggggtgaacctcagcactcccacacctcccttccagcaggccagtggttatggccagcacggctacagtacaggttatgacgacctgacccaggggacagcagcaggagactactccaaaggtggctatgctggatcatcgcaggcaccaaacaagtctgcaggttctgggcctggcaaaggagtatcagtgtcttcaagcaccactggtctacctgatatgactggttctgtctacaataagacacagacttttgacaagcagggatttcatgcagggacgcctccacctttcagcctgccctcggtcttgggctccactgggcccctggcctcgggagcggcccctggctatgcacccccaccattcctacacatcttgccagcccaccagcagccccactcacagctgctgcaccaccaccttccgcaggatgcacagagtggctcgggtcagcgcagccagcccagctccctgcagcccaagtctcaagcctccaaacctgcctacggcaactctccatactggacaaactaaacccagaagagaggggtgggctggggcaaggcttatcctgggcaggagagaacacacgagcacgtatttgggagcccagtgccctttcctagaattcccgacatgtgtcagccatgcctctgtggggagtctgcctcccagactggctactgtatgtaatgtatttatgtatgtatttgtaaatgtgatagaagtctgggggggagttgggggatggcggcagatgttagccaggtctgccctccccattcaagccccttctccactgtagcaaaataagcacccccaccccatctgccttcaggtcttcttcacagcctgcactgcccagtgggccactaggggcagtctctggaagggctggttcaaggctgtttgggtataggggtcaggtaccaatgaagaatcacgacttgtctcactcctttggaaattgttttctttcctgtgtaattacttcatacctctgtttttgagaaactgttccgtttgtcatctgtcatggtctccttccaccaaatcttcatctgggaatagcagcggtatccctccacccaagtatggccacctgtttgtcttcatatagaacaggggcttctggtctggtcatgtccctagagacttactagagactggctgaccatgaaaaaaaaaaaaataatctgagttattcagccagtcagctcccctttaaaaatctaaggtatctccaagcaacacatctccattctagttgtcttgaaccacgtgggcaactgtttcaggggttttctcttgcccaatccccacctaataaagttctgagagcatgaaaaaaaaaaaaaaa

SEQ ID NO: 485 - DNA, 1398 bp, Human
cccacttcccccggctccagccggcgcaggcagcggcggcagcagcaggcgagcctcggccccgcaaggccatgaaggtgaagaagggcggcggtggggccgggacggcgacggagtccgctccggggccctcgggccagagcgtggcccccataccacagccgcctgcggaatccgaatctgggtccgagtcggagccggacgcaggcccagggcccaggccggggccgctgcagaggaagcagccgatcgggccggaggacgtgctggggctgcagcggatcaccggtgactacctctgctcccctgaggagaatatctacaagatcgactttgtcaggtttaagattcgggacatggactcaggcactgtcctctttgaaatcaagaagcccccagtctcagaacggttgcccatcaaccggcgggacctggaccccaatgctgggcgctttgtccgctaccagttcacgcctgccttcctccgcctgaggcaggtgggagccacggtggagttcacagtgggagacaagcctgtcaacaacttccgcatgatcgagaggcactacttccgcaaccagctactcaaaagcttcgacttccactttggcttctgcatccccagcagcaagaacacctgcgagcacatttacgacttcccccctctctccgaggagctgatcagcgagatgatccgccacccgtatgagacccagtctgacagcttctacttcgtggatgaccggctggtgatgcacaataaagcagactattcctacagcgggacaccctgaccccacggctgccctgaccccaggaggctccagttctgggctgggagctgtgacctccccaacgctcacccctcaaccccaagtcctctgcttggggagttctccaggagctccggaccctgagtcaatgttgggaggaagggtacctggtgtccccagtcaagcccatgaagcccatgcggcctgctacatggggtggggtcgtagggaggctgtttgcctccacgtctaggaaggcctgtgagaggagcagtcaggacttccggacaacttagctgggccctacttgggcccaagtttcagaatagtgttcccctatcaaggctgtgactagatcaggcagggatccattccctgtcccctgcccactaccttcaggccatttagagttgtaaatttacaaagatccacggtgggctccagctgccaagccacccaagggagtctgggccctaggcctagccccatccctccccatgaggggccaagacactgcctaaggtgtgggagggactggctgagattgcagcccatggtaggagctggaccaactgtatatagttttcaataaactttttccttttctgttcaaaaaaaaaaaaaa

SEQ ID NO: 486 - DNA, 4185 bp, Human
aaagggacaatgtcccccgagcggtggaggcggcggcggctgcggaggccgcggcaccggcaccgggagcggcagcggcggtagcggcagcgacggccgcaccaaggaggggagctccgagccccggcacctggccggcggcgccgcctccccggcccacaatgccccgctgagccggtgcagcagctgagtggatccaagcagagaaaatccgatggaggggtctctggcaggcagcctggctgcaccagatcgtccccaaggcccagagagactgcctggcccggcgccaagggagaacatcgagggtggggccgaagctgctgagggggaaggtggcatcttccggtccacccgttacctgcctgtcaccaaggagggcccccgagacattctggatggcagaggtggcatctctgtggccaactttgacccaggcaccttcagcctgatgcgctgtgacttctgcggggctggcttcgacacacgggccggcctctccagccacgcccgggcccacctacgtgacttcggtatcaccaactgggagctcactgtctcacccatcaacatcctgcaggagctgctggccacctctgctgctgagcagccccccagccccctgggccgagagcctgggggtccgcctggcagcttcctgacctcccgtcggccccgcttacctctcacggtgccctttccacccacctgggctgaggaccctgggccagcctatggagatgcctcaggcccagagccagcacgagacatccgctgcgagttctgtggtgagttcttcgagaaccgcaagggcctctcgagccacgcgcgctcccatctgcggcaaatgggcgtgaccgagtggtacgtcaatggctcgcccatcgacacgctgcgggagatcctgaagagacggacccagtctcggcctggtggacctcccaacccaccagggccaagcccaaaagccctggccaagatgatgggcggcgcaggtcctggcagctcactggaagcccgcagcccctcggaccttcacatctcacccttggccaagaagttgccaccaccaccgggcagccccctgggccactcaccaactgcctctcctcctcctacggcccgaaagatgttcccaggcctggctgcaccctccttgcccaagaagctgaagcctgaacaaatacgggtggagatcaagcgggagatgctgccgggggcccttcatggggaactgcacccatctgagggtccctggggggcaccacgggaagacatgacacccctgaacctgtcgtcccgggcagagccggtgcgcgacatccgctgtgagttctgcggcgagttcttcgagaaccgcaagggcctgtcgagtcacgcgcgctcacacctgcggcagatgggtgtgaccgagtggtccgtcaatggttcgcccatcgacacactgcgagagatcctcaagaagaagtccaagccgtgcctcatcaagaaggagccaccggctggagacctggcccctgccctggctgaggacgggcctcccaccgtggcccctgggcccgtgcagtccccactgccgctgtcgcccctggctggccggccaggcaaaccaggtgcagggccggcccaggttcctcgtgagctcagcctgacgcccatcactggggccaagccctcagccactggctacctgggctcagtggcagccaagcggcccctgcaggaggaccgcctcctcccagcagaggtcaaggccaagacctacatccagactgaactgcccttcaaggcaaagacccttcatgagaagacctcccactcctccaccgaggcctgctgcgagctgtgtggcctttactttgaaaaccgcaaggccctggccagccacgcacgggcacacctgcggcagttcggcgtgaccgagtggtgcgtcaatggctcgcccatcgagacactgagcgagtggatcaaacaccggccccagaaggtgggcgcctaccgcagctacatccagggcggccgccccttcaccaagaagttccgcagtgccggccatggccgtgacagtgacaagcggccgtccctggggctggcacccgggggcctggccgtggtcggccgcagtgccggaggggagccagggcccgaggctggccgggcagccgacggtggtgagcggcctctggcagccagcccgccaggcaccgtgaaggctgaggagcaccagcggcagaacatcaacaaatttgaacgccgacaagcccgccctccagatgcctccgcagcccggggaggcgaggacaccaatgacctacagcagaagctggaggaggtgcggcaacccccaccccgagtccggccagtcccctccctggtgccccggcccccccagacatcacttgtcaagttcgtgggcaacatctacaccctcaaatgcaggttctgtgaggtggaattccagggccccctctccatccaggaagagtgggtgcggcacttacagcggcacatcctggagatgaacttctccaaagcggaccccccacctgaggagtcccaggccccgcaggcacagacagcggcggcagaggctccctaacacaaaagcattccagatcccctctcgtgccacctctgtctcctcttcttcctcctctgtgtccttgtccctcttcctctttctttccgtttccaaaggagcaagccaaaacctcaaaccggcgccccttgggggccgggcacactacagccagggcgccgggagccagctagctgcccttcccccagcccgaggactctggggccacagggtgtcttccttcagcccatgcccacctggtccagcaggggcagcagccaggtctctgatggcagccggtctggtcacaggggaggacagcactcccccgtctagcagccaggcagggcgatgtctgccatccgtggccatttgcaaagaccccaaagacccctgttctggttccctctctcccccatgaatatcctctcacacacatgtacatgcgaacacacacaacacgcacctcgtgagacccgggacctgccccggacccccagttcctgggttgaacgaccacatcatgccacggtgcttgctcaggggaagccacgctccctctgtggggcctgctggggcctgggagccccccactgagcccacaatgccacggaaatccttgttggctgcccccgagaggggccttcccagctgggaagagctcagagctgacagctgcctcctgccatgtcaaggccccccaaagagcctcaggggctctggggccctggagggtggggttggggggtgggactctcctcccccactcctgctccctctcccttttcactgttgctttctatgtatagctccctagacctttcacttttttaaaaacgcgttttgtgtagagaataaggaacgtggatctttttattttgcaatcctgggccagctagaagccaggagctgattgaccttttaacttttttcagtggccacattttggttatcgatgtacctagaagtatgtaaattagattaaatttctcttctggaaacaccctggggcaggcggccagcgtgtgtttttctgtcaagtggacaggctggcattggctggcagccggggctgggatcggggcctcctctgtccagagcgccatggaggccctgggttttccagttggccgccaagccgaccagacgcagctggggatgagcccaagttcccagctgttggctctttaggccatggctgggagggggtctctggctggctggcaaagcggctccagtgagcagatgaaccagggttctgggcagcctgtctgggaagggagccaggatcaagaagcagttgaggctagaggagcttatcaaaggcaggagctaccagcgagggtgtcagggacccgttgggagcatttgggtgggggccagtggggttgtagagagctggaactcacctgcttttaatacatgtgacttctagtgagacacatgcacccctgacccaaggaacatgcggggaaaagaggagccactggctcctttgcgatgttatttattttctcgctctgcaaatgtttattgaacatttctgagattttaagagattttgttggctgctccttcttgtttattgcaaaaaaaaaaaaaaaaaa

SEQ ID NO: 487 - DNA, 1810 bp, Human
ggcgctgggcggctgcggcgcgcggtgcgcggtgcgtagtctggagctatggtggtggtggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgcaaaaaaaaaaaaaaaaa

SEQ ID NO: 488 - DNA, 8150 bp, Human
gtttacacgctccggggcctgtaggcgccgcgagttccggctgtcgccgtcgccgccgcggctcctggaggtcggttgcgacgagtaacggcgccaggacgagccctgcgccttctttttcgatatgtacccgaattggggccggtatggcgggagcagccactatccgccgccaccggtcccaccgccgccgccagtggcgcttcctgaggcctcgccggggcccgggtactcgagctcgacgactcccgcggccccctcctcctcgggcttcatgagcttccgcgaacagcacttggcgcagctccagcagctgcagcagatgcaccagaagcaaatgcagtgcgtgcttcagccccaccaccttcctccgccccctctgccgcccccgccagtgatgccggggggcggctacggagactggcagccgccaccgccaccgatgcccccgccacccgggccggccctcagctatcagaagcagcagcagtacaaacaccagatgctccaccaccaacgagacgggcctcctggtttggttccaatggagctggaatccccccctgaatctccccctgtgccgcctgggtcctatatgcccccatctcagtcttacatgcccccacctcagccgccaccctcttactaccccccgacctcatctcagccctacctgcctcctgctcagccgtccccttcgcagtccccaccttcccaatcctacctggcgcccaccccttcttactcatcctcctcctcttcctcgcaatcctatttgagccattcccagtcctacttgccctcttctcaggcatctccttcccgcccctcccagggccattctaaatcccaactactagctccaccaccaccgtccgccccccctggaaataagacaactgtccagcaagagcctttggagagtggggccaaaaacaagagtactgaacagcagcaagccgcccctgagccagatccctctacgatgactccacaggaacagcagcagtattggtatcgacagcacttgcttagtttgcaacagaggacaaaagttcatttgccaggacacaaaaagggtcctgtggtagcaaaggatacaccagagccggtaaaagaagaagttacagtacctgccaccagtcaagttccagaatctccttcttctgaggagcccccattgccacctccaaatgaggaagtgccacctcctctcccacctgaggaaccccagtctgaggacccagaagaagatgccaggttaaagcagttgcaggctgcagcagcacactggcagcagcaccagcagcatcgagtcggtttccagtatcagggaataatgcagaagcacactcagttacagcagattctacaacagtatcagcagattatacagcccccaccacatatacagaccatgtctgtagatatgcagctgcggcattatgagatgcagcagcaacagtttcaacatctttaccaagaatgggagcgagagtttcagctatgggaggaacaactccattcctatcctcataaagatcagcttcaggagtatgagaagcagtggaaaacatggcagggacatatgaaagccactcagagctatctccaggagaaagtcaattcatttcagaacatgaagaaccagtatatggggaacatgtcaatgccacctccttttgttccatattctcagatgcctccacctctacctacaatgccccctccagtgttgcctccttcattgccaccaccagtgatgccccctgccctccctgctacagtgccaccacctggcatgcccccacctgttatgccaccttctctaccaacctctgttcccccaccagggatgcctccttctctctcttctgcagggccaccaccagttctccccccaccttccctgtcttctgcagggccaccaccagttcttcccccaccatctctctcttcaacagcacctccacctgtcatgcccctcccaccattgtcttcagctacacctcctccaggaatacctccccctggagttccacaagggatacctcctcagttaacagcagccccagttccaccagcctccagttcacagagctcgcaagttccagagaaacctagaccagcactgcttcctactcctgtgtcttttggttctgccccaccgacaacttaccatcctccgttgcaatcagctggtccatcagaacaagtgaattcaaaagctcctttgagcaagtctgctctgccatacagttcattctcatctgatcaaggacttggggagtcttcagctgctccatctcagccaatcactgcagtgaaggacatgccagtgagatcaggtggcctgcttccagatcctcctagaagtagttacttggaaagtccaagaggcccaagatttgatggtcctcgaagatttgaggatttagggtcaaggtgtgaaggaccgagacccaaagggcctcgttttgaaggaaatcgccccgatgggccaagacccagatatgaaggtcacccagcagagggcactaaaagcaagtggggaatgattccccgggggccagcatctcaattttatattacccccagtacatccctaagtcctcgacagagtggaccacagtggaaaggccccaaaccagcttttggacagcagcatcagcagcaacctaagtcacaagcagaacctctttcaggaaacaaagaaccattagcagacaccagtagtaaccagcagaagaattttaaaatgcaatcagctgcattttccattgctgcagatgtaaaggatgtcaaggcggctcagtcaaatgagaatctaagcgactctcaacaagagccacctaaaagtgaagtctcggaagggcccgtagagccctctaattgggaccagaatgttcaaagtatggagactcaaatcgacaaagcccaagctgttactcagcctgtaccccttgcgaataagcctgtacctgctcaatctacttttccttcaaaaacaggggggatggagggaggaacagcagtagcaacatcatcattaacagcagataatgattttaaacctgtgggtattggtctaccccattcagaaaacaaccaagataaaggcctgcctcggccagataatagagataatagattagaaggcaatagaggcaacagctcatcttacagaggtcctgggcaaagcagaatggaagacacacgggataaaggtctagtaaacagaggtcgcggccaggcaatcagtcgaggcccaggattggtcaagcaagaagactttcgggataagatgatgggtagaagagaagatagtcgagagaagatgaacagaggagaaggtagccgggacagagggttggtgaggcctggaagcagtcgggagaaagtgccaggtggtcttcaagggagccaggacaggggtgcagctggcagccgagaaaggggaccacctcggagggctggcagtcaggagaggggacctcttcgaagggctgggagtagagagagaataccaccccgaagagctgggagcagggagagaggaccacctcgagggcctggcagtcgagaaaggggactgggaagatcagattttggtcgtgatagaggtccattcagaccagaaccaggagatggtggggaaaaaatgtatccatatcaccgggatgagcctcctagggctccatggaaccatggagaagagcgagggcatgaagagtttccattagatggtagaaatgctccaatggaacgagaaagactcgatgactgggatagagagagatactggagagaatgtgaacgtgactatcaagatgatacactagagctctataacagagaggacaggttctcagcaccaccatctcggtctcatgatggagataggcgaggcccttggtgggatgattgggagagagaccaggatatggatgaggactacaatagggaaatggaaagggacatggacagggatgtggatcggatttcaagacctatggatatgtatgatagaagtttggataatgagtgggacagagattatgggagaccactggatgaacaagaatcacagtttcgtgaacgggatattccatctcttccacctttaccgcccctcccacctcttccacctttggatagatatcgggatgatagatggagagaagaaagaaatcgagagcatgggtatgatcgagatttccgtgataggggtgagttgaggattcgagagtatccagaaagaggagatacatggcgggaaaagcgagattatgttcctgacagaatggactgggaaagagaacggttgtcagacagatggtacccatctgatgtggatagacattcccccatggcggaacatatgccctcctcacatcattcctcagaaatgatggggtccgatgcaagcttagactctgaccaaggccttggaggggtaatggttctcagtcagaggcagcatgaaatcattttgaaagctgcacaagaactgaaaatgcttcgggaacagaaagaacagcttcaaaagatgaaagacttcgggtctgagccacagatggctgaccatctaccacctcaggaatcaagattgcagaatacatcttcaagacctggaatgtatccgcctccagggtcgtatagacctccccctcctatgggcaaaccaccaggttcaattgtaagaccctctgctccaccagcaagatcatctgttcctgtgaccaggccacctgtcccaataccaccacctccacctcctccacctctacctcctcctcctccagtgataaagccacaaacttcagctgtagaacaggaacgatgggatgaagattctttctatgggctctgggatacaaatgatgaacaaggactgaattcagaatttaagtcagaaactgcagcaattccatctgctccagtattaccacccccacctgttcactcttccattccccctcctggcccagtgcctatgggtatgccaccaatgtccaagccaccaccagtacaacagactgttgattatggccatggccgagatatatccactaataaagttgaacagataccttatggagaaagaataactctacgcccagatccactacctgaaagatcaacttttgagacagagcatgcaggccaacgtgatcgttatgatagagaaagagatcgtgagccttattttgatcgtcaaagtaatgtcatagcagatcatcgagattttaaaagggatcgtgagacacatagagatcgagaccgggatcgtggtgttattgactatgaccgggatcgatttgacagagaacgccgaccccgagatgatagagctcagtcatatcgagacaaaaaagaccattcctcatccagaagagggggttttgataggccatcctatgaccggaagtctgaccgaccagtctatgaaggaccatccatgtttggaggagaacgaaggacttatcctgaggagcgaatgcctctgccagctccttcactgagccaccagcctcctccagctccacgagtcgagaagaagcctgaatcaaagaatgtggacgatattttgaaaccaccgggccgggagagcagacctgagagaattgttgttataatgagaggattacctggcagtggaaagacacatgttgcaaaacttattcgagataaggaggtagaatttggaggacctgcacccagagttctaagcctggatgattacttcatcactgaagtggaaaaagaagaaaaagatccagattctggaaagaaagtgaaaaagaaggtaatggaatatgaatatgaagctgagatggaggagacttaccgcaccagcatgttcaaaactttcaaaaagactctggatgatggcttttttcccttcatcatcctggatgccatcaatgacagagttaggcattttgaccagttttggagtgcagcaaaaaccaagggatttgaggtatatttggctgaaatgagtgcagataaccagacttgtggcaagagaaatattcatggaagaaagcttaaagaaataaataagatggctgatcactgggaaactgcacctcgtcacatgatgcgtctagatattcgttctttgctgcaagatgctgctattgaagaggtagagatggaagattttgatgcaaatatcgaagaacagaaagaagaaaagaaagatgcagaggaagaggaaagcgaactgggttacattccgaaaagcaaatgggagatggacacatctgaggcaaagctagacaagttggatggcttgaggactggtactaaaaggaaacgtgactgggaggccattgccagcagaatggaggattatcttcagctccccgatgattatgatactcgtgcttctgagcctgggaagaagagggtcagatgggcagacctggaagagaagaaggatgcagataggaaaagggccataggttttgtggtcggacagactgattgggagaagatcacagatgaaagtggtcacctggctgaaaaagccctcaatcgaaccaaatatatatgagacttagtttttgaacggagtcattattcctctaaggtggttcgctttgaggtggtctgaagccaaggcctcgcggagcttctttgtgtgtcaccttgcttccacgtttcagttcttgttttgtttctactgctttagttttttttaaagttctccagtgtccccaagaggtattagaatcttgctgtacccaagcaagacgttaatttttcttttaactgttttggggagggagggagtgatagcttaactgctgaagccaggcgggggtctgctggaggattccaacagagagtatttcctccactgtacaatgtcacagactatctctatcatcattgctttgtggctgtttctgttttttactgtatgtaactggtagctgattgtactaggattaaaaacaataaactttcatgataaagccgatgagattcatgggctatacagcatgggcccttttctcttgttttcttaattttatttttaattgctttttaaatatggtatgtcctaattaaatgctagctgaacatcccaaaacctttttttcattgaatattatatggctcaatgattccgtagcacatgttgtaaaacacagggttcaaatgatgttcaaaacactcatctttgttttatagctgatttctctatctttgtgtcttgaagactgaccaagttcaaatattcatcagttccctggagcatatccattctgtaacatgatgctttatttaaaaattttttttgatcctctctctgttcttccctctcttctttccttccttcttcttttcactttctgcctttatgctgttaggtttttattttttcctgatctggctttgaattctggtagacagaactgatgtattctgtggaactcaagcttgttgccttcatttgaacttgaattgtggatttttaaatgaagattgcagggaaagagtataaagatgcagagcactctggcatgtaacctttaagcctgtcaggttttcaagttcttgccagattgttcattactggaaagcatggccttctgcacagaatttcctctcttgtggttaataccaggtggaacccagaaacatacagagataaaacccaaatattatttctatgtaaacacagaaaagggactcttccctttttcatcctgcaaagaaaaaagtcatcttttagcatgaaagaagatgagagagccttcttcctcaagcataatttgcattttgtaatccaactcagtaatttgtaaatgtgttcactgaagacttcaatattttgaaatattctctttcaggccacagatgaaaatcctttacttttatgacctacattaaagactgtatgaatagagctaatagttactagcatttgaatagtatcactttgggttcaacaaattgatattatagtactgaatacccctaatttaatggaaattctaacaactttctgtacttttatcttccctgaaaatctgaatttttaagcaagtgactttaagttcattaagtcaatattgaatgtataaattgctacattaaataacttctgctgtttgtaaaaaaaaaaaaaa

SEQ ID NO: 489 - DNA, 1635 bp, Human
aggcgcgctgggtcttgtgggtggaaacgcgctggctgactggggtcggcgtttagttcagcgcagcgactcggggacctggagctgacgcctagacacttgtattagctttaatagaagagaaatggaggagccatagaatattaaggatgaattcaggaaggcctgagaccatggaaaacttgcctgctctctacactattttccaaggagaggttgctatggtgacagactatggggcctttatcaaaatcccaggctgtcggaagcaaggtctggtccatcgaactcatatgtcatcctgtcgggtggataagccctctgagatagtagatgttggagataaagtgtgggtgaagcttattggccgagagatgaaaaatgatagaataaaagtatccctctccatgaaggttgtcaatcaagggactgggaaagaccttgatcccaacaatgttatcattgagcaagaagagaggcggaggcgatccttccaggattacactgggcagaagatcacccttgaggctgtcttgaacactacctgcaagaagtgtggctgtaaaggccactttgcaaaagattgtttcatgcaaccaggtgggactaaatactctctgatacctgatgaggaagaggaaaaggaagaggcaaagtcagcagagtttgagaagcctgaccctacaaggaatccttctagaaaaagaaagaaggagaagaagaaaaagaaacatagagataggaagtcatctgactctgacagctcagactctgagagtgatacaggcaagagggcaaggcacacatcaaaagacagcaaggcagcaaagaagaagaaaaagaagaagaagcacaagaagaagcacaaggagtgagagtataaagagtgtagggggtggttgagagtaagaaaccaggagccttgtgccttgagactcctggaaagactcaatagtgagaatatagcctcccaccccattaacttcgctcccatgggagatggcttcccctcatgcaacaggcaggtttgggagttagaggtcaaaagcagctgcctgaatgagttgttgtttccttatcactcctggtccctttgcaagtgaaccctgcagctcacccattcattcacccaacttccttcattcagcaggaggtcctattaccctctccagctgccactgccagagctggattcctgtaaaggagtccaggctagagccacagagactgttgtggaggtgagttcggctgtagttagagtgattggacccttcctattggtctgtcctgggccaactggtgggtgatctctgctgcatccaacatgggagcagagactggcagcaggaggggggaacatggtgagaagtggtgctcacttttcccattcctcctaacatagttctactatgctagaagtggcatccagcggccacagctagaaaacagtctgcagtgtgacttaacttgtgtattgcattccagcagaccactgaaccagacagcgaagccaagatcattgttctactttgtatttactactgtgtgaatcagttgattctacttcaggtccttgcttaaattcctgtcactaaatggaaatgtgtttggttttaaacttactgagttattttt

SEQ ID NO: 490 - DNA, 1445 bp, Human
gggcactatgtgcttccggtctccaataccgcaggagggcggtcttccccggctcgccaactcggctgctctgggggattcgtgcgcggtaagaagctgcgcggtagcgcggtgaggtaccactgatgaaattatgaccaggtgggcccgagttagtaccacatataacaagagacccttgcctgcaacatcatgggaggacatgaagaagggatcctttgagggaacaagccaaaacctaccaaagcgtaaacaacttgaagccaataggctatccctcaaaaatgatgcaccccaagcaaaacataaaaagaacaaaaagaaaaaagagtacttaaatgaagatgtgaatggattcatggaatacctaagacagaattcacagatggttcacaatgggcaaattatagcaacagacagtgaggaagtaagggaagaaattgcagttgctttaaagaaagacagtcgacgggaaggaagaagattaaaaagacaagcggcaaagaaaaatgcaatggtgtgtttccattgtagaaaacctggtcatggaattgcagattgccccgccgcccttgaaaatcaagacatgggcactgggatatgttacaggtgtgggtccacagagcacgaaataaccaagtgtaaggctaaagtagacccggctcttggcgaatttccttttgcaaaatgttttgtttgtggagaaatggggcacctgtctagatcttgtcctgataatcccaaaggactctatgctgatggtggcggttgcaaactttgtggctctgtggaacatttaaagaaagattgccctgaaagtcagaattcagagcgaatggtcacagttggtcgctgggcaaagggaatgagtgcagactatgaagaaattttggatgtacctaaaccgcaaaaacccaaaacaaaaatacctaaagttgttaatttttgataacagctagcactatcatgagttactacctcattgttactttctaaaccaggcccgcttcacgagttagagttgagctcccctgtagccaggactatgctgtagatatcagtatgatctgggtgtggccaaaaacaattttctttattctgtctatcaaatagtacttctaccactgtttggagaaaattgaagaaaagaataagatgattaaatgaattctctaaaagaacatattttaagagacagaacttagacataaccaagtagttgtatacctgattgtaacaatcatcttttataaaagcaaaattatgcataaatgtaaaacacccctaaacaaagggaacaaatgaatttttggttatattgttttcttggctcaaagtatcaatttattattataatagaaatttataagttgctagaaagtctatatttttaaagtacggaataaaaatatgttttctattaagcaatagaaaaaaaaaaaaaa

SEQ ID NO: 491 - DNA, 437 bp, Human
atgccggaggtgtcatctaaaggtgctaccatttccaagaagggctttaagaaagctgtcgttaagacccagaaaaaggaaggcaaaaagcgcaagaggacccgtaaggagagttattctatttacatctacaaagtgctaaagcaggtccatccggacactggcatctcttcgaaagctatgagcattatgaattccttcgtcactgatatctttgagcgtatagcgagcgaggcatcacgtttggctcactacagcaagcgctccaccatttcttccagagagattcagacagcagtgcgcttgctactgccgggagagctggctaaacatgctgtgtctgagggcaccaaggctgtcactaagtacaccagctccaagtaagcctgctaagtaaacgtcatttctaacccaaaggctcttttcagagccactta

SEQ ID NO: 492 - DNA, 1814 bp, Human
caaatatttaccgccgcgcggagagtgagggcccaagtccgccctgctccgccacttaggccgccccagacgcttccctcggggctgccaccgggtcgggcgcggctgccgcggctagcgggccttccccgcaccggcgcggcccaaccgccaccgaaccttctggaagcggcggctgcctgggcccccacgccgccagaatcgtacgcccgcgcgagctctctgcagccttggcggcctgggaggcggggctcggggtggggccggcgcgggggcggggtcggcgcggggaggccgcgttcgattgcccccggcgcgcaggccccgcctcaccagccccatcgctccacctctgccctccccctttatggcgcggcccgggctcattcattccgcgccgggcctgccagacacctgcgcccttctgcagccgcccgccgcatccgccgccgcagcccccagcatgtcgggcccagacgtcgagacgccgtccgccatccagatctgccggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctggaaaaaaaaaa

SEQ ID NO: 493 - DNA, 2258 bp, Human
ctgctgtcaatcgggccaggtgggagcgatgattggccgccgggcccgccctccagaaagccccgcggggctcgcgtaggctgcaggctcggggagggagggcagcggcgccgcgtcgggagccgccgccgtcccggtcctcccgcccgcccgcccatccggtgcctcctgcagcccgcctgctgggcagggccggcgcggcccggccatggagtcctacgacatcatcgccaaccagcctgtggtcatcgacaacggttcgggggtgattaaagctggctttgcaggagaccagattcccaaatactgtttcccaaactatgtcgggcggccgaagcacatgcgggtgatggctggagccctggagggggacctcttcatcggaccaaaagcagaggagcaccgggggctgctgaccatccgctaccccatggagcacggcgtggtgcgagactggaacgacatggaacgcatctggcagtacgtctactccaaggatcagctgcagaccttctcggaggagcatcctgtgctcctcacggaggccccgctcaacccgagtaagaaccgggagaaggcggcagaggtgttctttgagaccttcaacgtgccggccctgttcatctccatgcaggctgtgctcagtctgtacgcaacaggacgcacgacaggagtggttctagactcaggggacggggtcactcatgctgtgcccatctatgagggctttgccatgcctcactccatcatgcgggtggacattgccggccgcgacgtctcccgctacctccgactcctgctgcgcaaggaaggggttgacttccatacctcggctgagtttgaggttgtccggacaatcaaagagcgagcgtgctacctgtccatcaacccacagaaggatgaggctctggagacggagaaggtgcagtacacgttgccagacggcagcacgcttgatgtggggcctgcacgattccgggcccccgagctgctgttccagccggaccttgtcggggatgagagtgaggggctccatgaggtggtggccttcgccatacacaagtccgacatggacctgcgccggacgctgttcgccaacatcgtgctctcaggtggctcaacgcttttcaaaggcttcggagaccgattactcagtgaagtgaagaagcttgccccaaaggatatcaaaatcaagatctcagccccgcaggaacggctgtactccacatggattggcggctccatcctggcctcgctggacacttttaagaagatgtgggtgtccaaaaaggagtatgaagaggatggctcccgtgctattcatcgcaaaactttctagtgcccaaggagggcggggcatgttgggagagggggagggaggggagacagagcctttaaccctttttggtcttggctcgtatactaggcttagggtcccctgcatgccctgaacccctgggtgggtggcacagcagtgcccccctgcagccttcccctctacacaggacatgcacacacaagtaacattgagctgcatggacaggagccttgagctggcgtgtgggaattgagcgccatgtcaggctgttgtgggtatccccctggcagggccagctaggcctgtggttccctgctccgactctcagggctgcctccctgagctccagggccagaatgcctggatgcctgggtagccagtttggggagtgggctgcaaggggcagccagcagctcccactggtgtgtcactgcatccattgccacctcctgttcgtgacctgacagggtgacacagcccctttcacactctgtcctcctatcttcctgggtagatgccctggtgtagggctgagtactgaatggtcttccatccccagcaagggggtgcagcccagggtcaggcccttcagagccagggcagaggatgcacggtggctagagccgctgcactatccttttcagagcacttcatccacttgctcctccctctaccctcggcaccctgggtgggaaagggttgatgctcatcatttattgaggggaagccacttaataaggagtcagacctaaaagggggtgggggacattttcttacctcacccaagaaagaggtcgtcacttttgctgtggccagggccccacctccctctctcagatatgtacaataatttaacacggttgcctgaaaaaaacttttgtaaatcattatagtaataattatggacaaggcccagtgtgtggctctgttttcttgtggc

SEQ ID NO: 494 - DNA, 3970 bp, Human
gcacccaggtcgggcggtgggggcgagcggaggggctgaggggcggagaggcctggcgggccgctgctgcgggccaggggacgggggcggagccggagccggagccgacgggcggtggccgcactgggaccccggaatcccgcgcgctgcccacgattcgcttctgaggaacctagaaagattgtacaatgaatggtgattctcgtgctgcggtggtgacctcaccacccccgaccacagcccctcacaaggagaggtacttcgaccgagtagatgagaacaacccagagtacttgagggagaggaacatggcaccagaccttcgccaggacttcaacatgatggagcaaaagaagagggtgtccatgattctgcaaagccctgctttctgtgaagaattggaatcaatgatacaggagcaatttaagaaggggaagaaccccacaggcctattggcattacagcagattgcagattttatgaccacgaatgtaccaaatgtctacccagcagctccgcaaggagggatggctgccttaaacatgagtcttggtatggtgactcctgtgaacgatcttagaggatctgattctattgcgtatgacaaaggagagaagttattacggtgtaaattggcagcgttttatagactagcagatctctttgggtggtctcagcttatctacaatcatatcacaaccagagtgaactccgagcaggaacacttcctcattgtcccttttgggcttctttacagtgaagtgactgcatccagtttggttaagatcaatctacaaggagatatagtagatcgtggaagcactaatctgggagtgaatcaggccggcttcaccttacactctgcaatttatgctgcacgcccggacgtgaagtgcgtcgtgcacattcacaccccagcaggggctgcggtctctgcaatgaaatgtggcctcttgccaatctccccggaggcgctttcccttggagaagtggcttatcatgactaccatggcattctggttgatgaagaggaaaaagttttgattcagaaaaatctggggcctaaaagcaaggttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaagtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaagaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcacgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggctgctttttgctttcttctttccagaccccacagtagagcacttttcacttatttgggggaggcttcaggggactgttctcaccttaactcagccagaaagatgccctagttgtgatcaaaggtaactcgaggtggagggtagccctggggcccctcgacatcaccgtcattgatggagcctgaaccgtgtgctcctcggcagatgctgttgttgttacttccctccaagaggctggaaaagggctcagagctgctgagcaggaaccggagggtgacccatttcaggaggtgccggtaccagcctgactaggtacaggcaagcttgtgtgggcccaacaggcccttggtagagctggtgccagatgtgggctcagatcctgggcatgatgggccgagccacctcggatcccactgattggccagccgagcgagaaccaggctgctgcatggcactgaccgccgcttccagcttcctctgagccgcagggcctgctacgcgggcaagcgtgctgcctctcttctgtgtcgttttgttgccaaggcagaatgaaaagtccttaaccgtggactcttcctttatcccctcctttaccccacatatgcaatgacttttaattttcacttttgtagtttaatcctttgtattacaacatgaaatatagttgcatatatggacaccgacttgggaggacaggtcctgaatgtcctttctccagtgtaacatgttttactcacaaataaaattctttcagcaagttccttgtctaaaaaaaaaaaaaaaaaa

SEQ ID NO: 495 - DNA, 1946 bp, Human
gcccaggctggagtgcaatggtgtgatctctgctcaccacaacctccgcctcccaggttcaagcgattctcctgtctcagcctctggagtagctgggattacaggcatgcaccaccacacctggctaattttgtatttttggtagagacagggtttctccatgttggtcaggctggtcttgaactcccaacctcaggtgatccacccacctcggccacccaaagtgctgggattataggtgtgagtcactgcacctggccaacagcaatactttctttcctttcttttcctctaccctctatgccaggactccttagaaataaaatattaaggaaagtgagttatgaagatgataagggcaatgcagactacagaattatgggtgtctttgaactgctgcttcctgtaaaatgccaaaaacttctttgggcacatgatggttcccagcttgagagatctgtgagctccagttggaatgtttcatggcaactagttttcttaatgttctttttcagatatatgaaatcagggcatcttttcaggaggatgcttcctattcagaggttgcaaagcacttatgtaagccttaggtgactgcatgggtggaagtgcacagagttcaccatctgaagcttaatctggggccagcagttctgatacctgttgtatttgcgttacaaatgaacttgagcaccgaggccctcatgcccactgtcctgtaagtgggcgctcggcctggattgcagctctgccctgtctgtagtgagggctgcctgctgctcctttacttctcttcctgtattcctaggattgacttttgcttcctgctgtaactactctgtttcttcttcccagctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaattaaaaaaaaaaaaaaaaaaaaaaaa

SEQ ID NO: 496 - DNA, 2266 bp, Human
gggaacgccggctcccggcatgccgcgcgctgacagccttataaatagtcgcctttgccggccgccgcgaggacgggcagggcacgcactggccccggcgcccacccgcacccctccccagagcactgacacggctcccgggacctcggcaggatggaagagaagctgaagaaaaccaagatcatctttgtggtgggtgggcctggctcagggaagggcacccagtgtgagaagatcgtgcagaagtatggctacacccacctctccaccggggacctcctgcggtccgaggtcagctcaggctcggccaggggcaagaagctgtcggaaatcatggagaaggggcagctggttccactggagacagtgttggacatgctccgggatgccatggtggccaaagtcaatacttccaaaggcttcctgattgatggctacccgcgggaggtgcagcaaggagaagagtttgagcgacggattggacagcccacactgctgctgtatgtggacgcaggccctgagaccatgacccagcggctcttgaaacgtggagagaccagcgggcgtgtggacgacaatgaggagaccatcaaaaagcggctggagacctattacaaggccacagaacccgtcatcgccttctatgagaaacgtggcattgtgcgcaaggtcaacgctgagggctccgtggacagtgtcttctcccaggtctgcacccacctggacgccctaaagtagcaacgctggagccgcttccccagctcagagccccgccccaccccgtcctgattcgaggtcctcctggcctgagcgcagcgcctccaccctgccctgctgagcacagacggaggaagccgcttatcctgttttcatggacagctgagcactaaaggaatttctaaggacatttggttttactgctttttctctgcttccagttggagttgattcatgtgcttgtgcctacctggccgcaagtccccagcccctcaaccctccgttcctcctcagcctccctttgccagccacccctcctctagctctggtgggaggcccggggcccttcctcgcacagggcatgcctggcctgaggacccggcgctgagtggcggggcccctgctccgaggggctcatgttcaggcagaaccggtcccagcctgggctcctctgcatcttgctctgtggccttggccctgacccccatcgctctgagcatatgttccatgcctggcccttgccggggcctggactgcacaggcagcaaggtcatggtctgagtggggcttcctgggcagttggggcggcccacgccagctggcccagtgggtagtgaattggcttccttgacgcgagaggctctgagggtctgaaaagggcatctcaatggcatgggtgggtggggagtcagtcatgtcactgaaattgaatgggggaggcccaatgaggtggctcatgcctgtaatcccagcactttgggaagctgaggcaggaggatcccctgaggtcaggagttcgagagcagcctggccaacatggcaaaaccccttatttactaaaaatacaaaaattagccgggcatggtggcatgtgcctgtattcccagctactcatgaggctgaggcaggagaatggcgtgaacccgggaggtggagcttgcaatgagccaagattgcgccactgcactccagcctgggtgacagagcaagactccgtctcaaaaaaaaaaaaaaaaaaaaagaaattgaattgggggagtcatggtcaggggtgagacctgaaggacctccccctgtgtggccctggacacagcccaccctctgtgagccgtttccaattctaaaacagactcaatgtccccctcacccccacctcaaggtcaggatgagaacacactgagtgaggagtggacgctgtccattgccacggccatgagggctggagaccagaacagcatggcccgaagcgtgcggggccccggatgacttggggacaccccagaatcccctggggagaacccttcctgcgcgctttcattttttgacctcatcactgagaaaggctcaatttggtgctcacgtgtccttaacacctgatctggcccaagctgggctccctttaagccaagagagcctcttgtggaccccgcctgcccgaatgaaatccgaacagttggggctgttcatggcaagtggggctggtttttcatttccattggttatttaaagtttcctttaaaataaacgattttaagttataaaaggtgaa

SEQ ID NO: 497 - DNA, 4048 bp, Human
aacttaaccggagcgtgcacacccgcctgcgaggctgacccgagcgcgtcccacccaaggtcgcccagccccgcgggcgtttacttttcaaagggagggataggagaagaaaggtgctgatcgtggtaggcggtgctgtggcgactcggaacggcatgggagccctgggcgtttcgggatcttcctctcctgggggatgtcctgggtggcggcgccttcctgccgccgttaacacaaacccggtggacttcgctccaggtgtaattacttcaagcctccaggatggcaatccagttccgttcgctcttccccttggcattgcctgggatgctggcgctcctcggctggtggtggtttttctctcgtaaaaaaggccatgtcagcagccatgatgagcagcaggtggaggctggtgctgtgcagctgagggctgaccctgccatcaaggaacctctccccgtggaagacgtctgtcccaaagtagtgtccacaccccccagtgtcacagagcctccagaaaaggaactgtccaccgtgagcaagctgcctgcagagcccccagcattgctccagacacacccaccttgccgaagatcagagtcctcgggcattcttcctaacaccacagacatgagattgcgaccaggaacacgcagagatgacagtacaaagctggagctagccctgacaggtggtgaagccaaatcgattcctctagagtgccccctttcatccccaaagggtgtactattctccagcaaatcagctgaggtgtgtaagcaagattcccccttcagcagggtgccaaggaaggtccagccaggctaccccgtagtccccgcagagaagcgtagctctggggagagggcaagagagacaggtggggccgaagggactggtgatgccgtgttgggggaaaaggtgcttgaagaagctctgttgtctcgggagcatgtcttggaattggagaacagcaagggccccagcctggcctctttagagggggaagaagataaggggaagagcagctcatcccaggtggtggggccagtgcaggaggaagagtatgtagcagagaagttgccaagtaggttcatcgagtcggctcacacagagctggcaaaggacgatgcggcgccagcacccccagtcgcagacgccaaagcccaggatagaggtgtcgagggagaactgggcaatgaggagagcttggatagaaatgaggagggcttggatagaaatgaggagggcttggatagaaatgaggagagcttggatagaaatgaggagggcttggatagaaatgaggagattaagcgggctgccttccagataatctcccaagtgatctcagaagcaaccgaacaggtgctggccaccacggttggcaaggttgcaggtcgtgtgtgtcaggccagtcagctccaagggcagaaggaagagagctgtgtcccagttcaccagaaaactgtcttgggcccagacactgcggagcctgccacagcagaggcagctgttgccccgccggatgctggcctccccttgccaggcctaccagcagagggctcaccaccaccaaagacctacgtgagctgcctgaagagccttctgtccagccccaccaaggacagtaagccaaatatctctgcacaccacatctccctggcctcctgcctggcactgaccacccccagtgaagagttgccggaccgggcaggcatcctggtggaagatgccacctgtgtcacctgcatgtcagacagcagccaaagtgtccctttggtggcttctccaggacactgctcagattctttcagcacttcagggcttgaagactcttgcacagagaccagctcgagccccagggacaaggccatcaccccgccactgccagaaagtactgtgcccttcagcaatggggtgctgaagggggagttgtcagacttgggggctgaggatggatggaccatggatgcggaagcagatcattcaggaggttctgacaggaacagcatggattccgtggatagctgttgcagtctcaagaagactgagagcttccaaaatgcccaggcaggctccaaccctaagaaggtcgacctcatcatctgggagatcgaggtgccaaagcacttagtcggtcggctaattggcaagcaggggcgctatgtgagttttctgaagcaaacatctggtgccaagatctacatttcaaccctgccttacacccagagcgtccagatctgccacatagaaggctctcaacatcatgtagacaaagcgctgaacttgattgggaagaagttcaaagagctgaacctcaccaatatctacgctcccccattgccttcactggcactgccttctctgccgatgacatcctggctcatgctgcctgatggcatcaccgtggaggtcattgtggtcaaccaggtcaatgccgggcacctgttcgtgcagcagcacacacaccctaccttccacgcgctgcgcagcctcgaccagcagatgtacctctgttactctcagcctggaatccccaccttgcccaccccagtggaaataacggtcatctgtgccgcccctggtgcggacggggcctggtggcgagcccaagtggttgcctcctacgaggagaccaacgaagtggagattcgatacgtggactacggcggatataagagggtgaaagtagacgtgctccggcaaatcaggtctgactttgtcaccctgccgtttcagggagcagaagtccttctggacagtgtgatgcccctgtcagacgatgaccagttttcaccggaagcagatgccgccatgagcgagatgacggggaatacagcactgcttgctcaggtgacaagttacagtccaactggtcttcctctgattcagctgtggagtgtggttggagatgaagtggtgttgataaaccggtccctggtggagcgaggccttgcccagtgggtagacagctactacacaagcctttgacccccatgctgcttcctgagagtctttttttgcactgttgaaattgggcttggcactcaagtcaaagatgaacatcggaataacaaacattgtcctctccagaaagtcctttctttctccatactgtagtcctattgagaagacatttcgtctctgagaaaaaaggatggaactatgggttctcttcgcaaagccaaaggatagtgtttaacaagccagctggcttatgctggttctcagctgtttaaaaaaaaaaaaaaaaaggaatagaaacagtttcaaccagattgtcctattccccctgttccattcccctcttcttccttctatctccttccccggcaaaaaccaaacaaactggcagacaggccagggatgtatgttgcttgcttgagagggtttcttttacttcaaaatctttcttcagggagcaagacatgaactgactaattggtatccactacttgtacagcttacataaatgagttgatgatatttaaccagtttttataaacttcatttaggtctctaaacacagactttttaaattgcaactgtaaatatgaaatggtcatcacatctgaccttggtcagtggggaggggaactggtatcctgccaagcctggttgtaatttgtaaccattttctatttgtgcaaactctgtaaatatgtgtttaaacaaatgtaatattttgtacaagatacactggagaacaaagggaactcaagattcttccagccacatgtcacctgtaggtagaagtaaactctgcagtgcagcttctgctcttggcccctctggccagggcccctgtggcttcctgcacactggacaggtgactgtatggtagagactgtgatctgggaactttttgctgtacaaatctgtttaaaaaaaaaaaaaagtaactcattgaattaacttgcagtggtgtgtttgattcttttttagactggcttcagcattgtgcagtttaaaaataagtaagtaacttacataaatcttcaattgtatgaaaaaaaaaaaaaaaaaaaaaaaaaaaaaaccactt

SEQ ID NO: 498 - DNA, 2794 bp, Human
cggcaggaccgagcgcggcaggcggctggcccagcgcagccagcgcggcccgaaggacgggagcaggcggccgagcaccgagcgctgggcaccgggcaccgagcggcggcggcacgcgaggcccggccccgagcagcgcccccgcccgccgcggcctccagcccggccccgcccagcgccggcccgcggggatgcggagcggcgggcgccggaggccgcggcccggctaggcccgcgctcgcgcccggacgcggcggcccgaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaaaaaaaaaaaaaaaaaaaaa

SEQ ID NO: 499 - DNA, 2701 bp, Human
gtgcctggagcgcgcgacagcggcggggcggggcggcctggaggctgtggcgcgcggccggcagagggaggggagaggccactggggccgtgttagtctgccggtggggactcttgcagggccgtccccatgttgcgttttccgacctgtttcccatccttccgggtggtgggagagaagcagctcccgcaggagattattttcctggtctggtcgcccaagcgggatctcattgctttggccaacacagctggcgaggttttacttcatcgactggcaagttttcatcgagtttggagttttccaccaaatgaaaatacaggaaaggaggtgacgtgtctggcatggagaccagatggcaaacttttggcctttgctcttgctgataccaagaaaattgttttgtgtgatgtagaaaaacctgagagcttacactctttttctgtggaggctccagtttcctgtatgcattggatggaagtgacagtagaaagcagtgttctcacatcattttataatgctgaggatgaatcaaatcttctcttacctaaactacctacactgccaaaaaactatagcaacacctcaaaaatatttagtgaagaaaattctgatgaaattattaagctcttgggagacgtcaggcttaatattctcgtccttggaggaagctctggatttattgagctttatgcttatggaatgtttaaaattgctcgagtcacagggattgctggtacttgtcttgcattatgtttatcaagtgatttgaaatcattatcagtggtcacagaagtctctaccaatggtgcttcagaagtttcatactttcagcttgaaactaatctgttgtactctttcttacctgaagtaactcggatggccagaaagtttactcatatttcagctctgttacagtatataaatttgtcactaacatgtatgtgtgaagcatgggaagaaatactaatgcagatggattctcgtctcaccaagtttgtgcaggaaaagaacacaaccacatcagtgcaagatgagttcatgcacttgctattatgggggaaagcaagtgctgaacttcagactctcttgatgaatcagttaacagtaaagggcttgaaaaagcttggccagtctatagagtcatcatactccagtatacaaaaattggtcataagtcatttacagagtggctcggagtctttattataccatttgagtgaattgaaaggaatggcttcatggaagcaaaaatatgaacctcttggactagatgctgcaggaatcgaagaagctataactgctgtgggttcttttatactcaaggcaaatgaacttcttcaagttatagatagtagtatgaaaaacttcaaagcattttttcggtggctttatgtggcaatgttgagaatgacagaagaccatgtgcttcccgagctgaataagatgactcagaaagatatcacatttgttgctgaatttcttactgaacatttcaatgaggctccagacctttataatcgaaaaggaaaatactttaacgttgaaagagttggtcagtacttgaaagatgaagatgatgatcttgtgtcaccccctaacacagaaggaaaccagtggtatgactttcttcaaaatagcagccaccttaaagaaagtcctttgctgtttccttattatcctcgaaaatcattgcattttgtgaaaaggcggatggagaatattattgatcagtgtttgcaaaagccagcagatgtaattggaaaatcgatgaatcaagcaatctgtattccattgtatagagataccagaagtgaggattctacacgtagattgttcaaatttccttttctgtggaataataaaacttcaaatctacattatcttctttttactattctagaagattcactttataaaatgtgcatcttaaggagacatactgatatttctcaatctgtgagtaatggactaattgctattaaatttgggagctttacatatgccacaacagaaaaagtcagaagaagcatctacagttgtttagatgcacagttttatgatgatgaaactgtaacagtagttcttaaagacactgtaggacgtgaaggaagagatagactcttggtccagctgcctttgtctttagtatataacagtgaagattctgcagaatatcagttcactgggacttattctacaaggctagatgaacagtgtagtgctattcccacccgtaccatgcattttgagaagcactggagattactggaaagtatgaaagcacagtatgttgctgggaatggttttcgaaaagtgtcctgtgtgttaagctcaaatcttcgtcatgtgagagtatttgaaatggacatagatgatgaatgggagctcgatgagtcttcagatgaagaggaggaggccagtaataagcctgtaaaaataaaggaagaagtgttgtcggagtcagaggcagagaaccaacaagctggtgctgccgctttagctccagagatagtcattaaagtggaaaaacttgaccctgagctagactcctaatctagcttgccattattgtgtgtgtaattatggccaaaaggacataggagatggactaagatgtcttggaccacctttgtgtaacaaagaaataaacagtaaattttattttttcaaaaaaaaaaaaaaaaaaaaaaaaaaaaaa

SEQ ID NO: 500 - DNA, 1683 bp, Human
ggctggggcggccctgaggacgcgtgcggggcaggtcacgcttgggcctggctgcctcaggagccaccctgcacggcgccgggcgaggctgtgcgcgccctcccggaccctccactttggggctttgcggtgtagcggcgcgccccactcccttacgtgttcagtcccgaatcacgtacgggccgctgcagctccaggacggcggacgccagcgctctcggatccccaggcccctccgtgctcatcccggaccgctccgtccctgaggaaaaaccgccccgtgcccggaaccgcggcttctcccacgcggggcaggccggggctgtgagggggcagcccgcctgcggactaggccgggggtttgaggaggcggctctgccggggacaaagccgggggcgtgaggggcggttctgccgggttcggggcgcgcggggcaggttgcgtgaagaggcggaaagtcccactcgccctcggcttctccctgcccggccgccggtgtcccgcccgccgcctccccgcgcagcccggcccgacccgcggcgatggcccagcccggggacccgcggcgcctctgcaggctggtgcaggagggccggctgcgcgccctgaaggaggagctgcaggcggccgggggctgcccggggccggccggggataccctcctgcactgcgccgcgcgccacgggcatcgggacgtgctggcctatctggccgaggcctggggcatggacatcgaggccaccaaccgagactacaagcggcctctgcacgaggcggcctccatgggccaccgagactgcgtgcgctacctgctgggccggggggcagcggtcgactgcctgaagaaggccgactggactcctctgatgatggcctgcacaaggaagaacctgggggtgatccaggagctggtggaacatggcgccaatccactcctgaagaacaaagatggctggaacagtttccacattgccagtcgagaaggcgaccctctgatcctccagtacctgctcactgtttgcccaggtgcctggaagacagagagcaaaattagaaggactcctctgcatactgcagcaatgcatggccatttggaggcagtcaaggtgcttcttaagaggtgccaatatgaaccagactacagagacaactgtggcgtcaccgccttgatggacgcaatccagtgtgggcacatcgacgtcgctaggctgctcctcgatgaacatggggcttgcctttcagcagaagacagcctgggtgcccaggctctgcacagggcagctgtcacagggcaggacgaagccatccgattcttggtctctgaacttggcgtcgatgtagatgtgagagccacatcaacccacctcacagcacttcattatgcagctaaggaaggacatacaagtacaattcagactctcttatccttgggagctgacatcaattctaaagatgaaaaaaatcgatcagccctgcatctggcctgtgcaggtcagcacttggcctgtgccaagtttctcctgcagtcgggactgaaggattctgaagacatcacgggcaccctggctcagcagctcccaaggagagcagatgtccttcagggctctggccatagcgcaatgacataaggatgtttccaagaggaggcaataaagtgcatggtaattcataaaaaaaaaaaa

SEQ ID NO: 501 - DNA, 7147 bp, Human
gggccgcgcgtggcggcggcgatgggcgagggcgggctgcccccggccttccagctgctgctgcgcgcgtgtgaccagggcgacacggagacggcgcggcggctgctggagccgggggcggcggagccagccgagcgcggcgcggagccggaggcgggcgcggagccggcgggggccgaggtggccgggcccggggccgcagcggcgggggcagtcggggctccggtgcccgtggattgctcggacgaggcgggcaacaccgcactgcagttcgccgcggccgggggccacgaaccgctggtgcgcttcctgctgcgccgcggtgcctcggtcaacagccgcaaccactacggctggagcgcgctcatgcaggcggccagatttgggcatgtgagtgtggcacacctcctgttggatcacggggctgatgtcaatgcccagaaccggctgggggccagtgtgctcactgtggcttctcggggcggccacctgggtgtggtgaagctgctcctggaagccggtgcctttgtggaccatcaccacccttcaggcgagcaactggggttgggcggcagcagggatgagcccttggacatcacagccctgatggctgccatccagcacgggcacgaggccgtggtgcgtctactgatggagtggggcgcggaccccaaccacgcagcccggaccgtgggctggagcccgctgatgctggccgcactcactgggcggcttggagtggcccagcagctggtggagaagggcgccaaccctgaccacctcagcgtgctggagaagaccgccttcgaggttgcactggactgcaagcacagggaccttgtagactacctggacccgctgaccaccgtcaggcccaaaacagatgaggagaaaaggcgacctgatattttccatgcattgaaaatgggaaacttccagctggtcaaagagattgccgatgaagaccccagccacgtgaacttggtcaatggggacggggcgacgccactgatgctagcagctgttacggggcagctggctctggtgcagctgctggtggagaggcacgcggatgttgacaagcaggacagcgtgcatggctggacggccctcatgcaggcaacctaccatgggaataaggaaattgtgaaatatctgctaaaccaaggggccgatgtcactcttcgtgcaaaaaatggatacacggcctttgacctggtgatgctgctgaatgatcccgacacggaacttgttcgactgctggcatctgtctgcatgcaggtgaataaagacaaaggccggccgagccaccagcctcccctgccccactcgaaggtccgacagccctggagcatcccagtgctgcccgatgacaagggtggactgaagtcctggtggaaccgaatgtccaatcggttccgaaagctcaaactgatgcagacgctgccccgtgggctgtccagcaaccagcctttgcctttctctgacgagcctgagccagctctggactccacaatgagggctgccccccaggacaagacaagccgctctgcactccctgatgcggcccctgtgaccaaagacaatggtcctgggagcacaagaggagaaaaggaagacacgttattgacaaccatgcttcgaaacggagctcccctcaccagactcccgagtgacaagctgaaagcagtcatccccccattcctacccccttccagttttgagctgtggagctctgatcggtcccggacgcgtcacaacgggaaggcagaccccatgaagactgcgctgccccagagagccagcaggggccaccccgtgggcggcgggggcacagacactacacccgtcaggcctgttaaatttccaagcctccccagaagcccagcctcttctgccaattctggaaacttcaaccactcgcctcattcatcgggcggctccagtggggtaggtgtgagccggcacggtggggagctgcttaaccgctcaggtggcagcatagacaatgtcttgtcccaaatcgctgcccagaggaaaaaagcagccggattattggagcagaaacccagccatcggtcaagccctgtggggccagcaccggggtccagcccgtctgagcttccagcctcccctgcaggtggcagcgctcctgttggcaagaaattggagaccagcaaaaggcctccatctggaacttccactacctccaagagcacctctccaaccctcacgccctccccctcacccaaagggcacactgcagagtcctcagtgtcttcctcgtcatcccatcggcagtccaagagcagtgggggctccagcagtggcaccatcacagatgaggatgaactgactggaatccttaagaaattatcacttgagaaatatcagcccatttttgaggaacaagaggtggacatggaagcgttcctcacactgactgacggtgacttgaaggagctgggaattaagacagatgggtccaggcagcagattctggcagcgatttctgaactgaacgcaggcaagggacgcgagagacaaattttacaggaaaccattcacaactttcactcttcctttgagagcagtgccagcaacaccagggcccctggcaacagcccctgtgcgtgatcctccttcccgcagccaccagcgtgagctctctgaatcccgggaccccttcacgtggccacagccccagccctgcccccgtcacactgctgtgccttagtcatgttgttccctttgctcgggatgcccacttcacgtcgacggcattcattggtagtacttcttgctgcaacaaacttcaacacacagagacagattcccatgtaacagtccagtgggggtgcttctgcttggcaggttggttcacacagtgatgcagggactcagctcctttcatcctgtgctctgccctccccgggagcctcagagtttgcttctggctggcggcaagggaaagggacgatggagaaggcacggctgcttcttacctgccttgctcttaactgacacacatcactcctgctcacgtcctcttggccactggtagtcatgtggccccacctggatgcagaggaggccaggatgtgcagtctccacatagtggcttcccagcaacaacttttgacttagatggggggtatgtattatggtgagaggttagccttcctggcacatcttcccttaaaacttctaacttgcccctcctagtccaagtcacctctcagatgaagtcttttttgaccccctttcagccactgggtcccttagtgctgtgtatgtgactgctgtagcattccactgcacctgctgcatacagcttacattggagatgtgtatgtcaaacgcatttttctttattgcaaagagagtctattatagaaggaaagaagtggaggcctgctgtgtggatcccttcttcttcctagctttcagtttccttatctgcaaagtggaaggtcagaccagatgatgctctggtactccacagtgctcacctgtatcactgcagggctttctgcactgaaagtggaagcagaaggctaatgggtcacattgtgtaaaggtctctggtgctcaaagtttctaggcaaagaagtgaaaatttggaattttgtctacatcctattaatgctgtgttcctcaaaagggaattggcttgtgtagtttcctaccatatcatattttattaaattagaggggccctgacttttaaaacccactggctttctgaagtgttttccagtgaatgactcattcagccagtgcttgttgcatttatgttagctaccaggtgccaagtgtgcagacacaatacagagccttcaggctctcgacaggcaagagaacacctgtaaatagatggtcccgacattgagaggcagcatggtagagtgggcagaccttgtgctctggactcaggttcaaagttcagatgaagctcaatggcctcttagttggagcttagaaccagtatgcccaaagtgctgggtctgcaggaagtacccagtcgatggtaggctgcacagaattctgatctctaccttgagccatgctgagccacaagttggtctccttgggaggtgccatctctcatctgtccctcccccagccatgaaagcccattcccctatgctggctttcagaggctgtcgttaacttactgcccagagcctcgtagttttcttcccctgccctgatggttgggtgtttttcctttaaattctctcagccttacactcacagaagccaactttccacaggactgaagacaaagtgtttcatttagctgttactgatagacacctttacaaaggttactaatgtcccagcctttttaaggagacacactcattcatcccctactatgtgctggcagctttacctttgtcatttcatcctcatggccaccctggaggtggcattgtgtaacctcatcttgcacattcgggaaacggatgcttaggagagggaagcagcttgccagttaaacagcccagaaggagcagatctggggtcagaaccggacctggtgggcttgcaagcctgtgccttttccactaactcctatagactcctggagctagaagcacttgtgattcttgttttaatttactgatggcttcaggggttaacagtaggcctagaattgtttgcctctgaaattcatggcccctgacgttatgtgctttgaggttttgtgcctgctttttgctgtggtcctgtttttttcataacaatatactggtatagcttccactcaggtaagtttgattgaacaatgatacacagctgcaccggggggtcaccttttcacaaatgtagacctccatgaactcattggatgaccctggacagagcggggctattcccattttgcagacaggacagcagaggctccagacaatgcctttcctttctttttcactggactcaagtgtccaaggcttttcatcctaggaagtttgtgtgctggttcacaagaggtccctggcaccctttctggggatgtttggatgcggctggtaggcagggaagagaaagggcaccccagcgggggcatgtgtggaggcagcacggaacatgtaggttatagatcgtcagggaggaggggtcagttgggtgcttgtttttctgatttttggtccttgatcacccccttcccttcccacacgtgtccccagcctgcctgtggctgttccccccacaagaagcacctcccttgcttggcaaccttcaccagcatttcccaaaagtatgctcctgggaaccctagttccacaggataataggtttttcataaagaaacgtagggtgtgtatgtgaaagtggggtgaggttccctggttgagtaggtttggcagacactaaagcgagctacacgatcatctttgctacaggcctctcacaaccttcagcatgccagcatgggtcaggcctcttcacagggccaagaaactcatagcatctcccacattactctcatcacttctccaaggtgcttttgcaagactggaattccttggacaccattggagaagccccgctttttctggaacagcggcaaccaagaggccttgcagccctggaagtgggtcagggcccttggtggtcacctttttctccccagcagctctgcagaggtggcctgcttggcagtgggacatcaggggaccggtcctgctttgagatggcagggtccctgttctgagagctctccagcctgagggcattgagctgaggctccaccctgagctctcctgcagggtggagggcattgtttcccagcacccaggcagtgtcttgctggtgtgtcgtgagtgctggatgtccaagtccctgctggccacggagggctcctgcctctcttcttcagcgccacaaaattacatggaggccagctggttttgtgaggagattgtttattttttaattcttttgtttaccgaacgtttactgagcatctaccctgtgccagccctactcgtacgctctgtctccaaagatgaaaaaggacttctctgccctcaagggaaccccacagtatcttagaggagacaatcatgtcggtgagatggtgtggtgatgaagcctgctgggtatacagctcagggaaagtcatcgatgatggctcaggctcagcctgggcacgccccagaggagagagatggagtggggcctcaaagggcaggtttaggcagaaaagaaaaagggcattccagctggggcatgtgcaaaggcagcacgtaatgtgtaagttctagatcgtcagggaggaagggtcagttgggtgcctgtttttctgtttttagtcctttaaaatgagtagaagcaacctgttaccctggaaagagcactggacatagacctagtgctgcgtgatgttgagcacgtttcttcttccctttgagtcccagtttcccttttggttacagggggatagtagcccccagggatcatgtgaaagtgagaaagcccttttcacactgtggagcggtgcagatgtgggaaacctcaaagatggttgcccattttaaatcctttcatctctcatctctctttcttctctcccttctgccctgacgtagccatggttgggtgggtgaggccagaagaaactgcctccggcaagaggtagcagccgctcaggtggctctgctggcatcggagcccacagaagtgaggagtggccgatggacctgccctccaaatgtgcctgactctgggtcttgctgtcactggatttcctggcatggcagacagaaagaaagatagtttgaccaagtcgtagaagctgatccagcgggtaaaaagggggcagggaactcgtcccttttattcttgcctcagagctgcctgaagacatgggccaggccggaggctggacaactttggataacgctgacctgtacttccaagtaaatgcctcctgaagagcccgggacccttcctgggagaattctgcagccagaatgaaggtgccatcagcaggaggcactgtgaagcaccatcctgtcgctgtccttgtccattcctagcaagttaatcgtgtcttgttaaccagcagttcctgttcaacgtgtaaagagacctgatgttttccctaataaagctgataacagattttgcagga

SEQ ID NO: 502 - DNA, 10740 bp, Human
gtattggtgcagcccgccagggtgtcactggagacagaatggaggtgctgccggactcggaaatggggtccaagggtagccaaggatggctgcagcttcatatgatcagttgttaaagcaagttgaggcactgaagatggagaactcaaatcttcgacaagagctagaagataattccaatcatcttacaaaactggaaactgaggcatctaatatgaaggaagtacttaaacaactacaaggaagtattgaagatgaagctatggcttcttctggacagattgatttattagagcgtcttaaagagcttaacttagatagcagtaatttccctggagtaaaactgcggtcaaaaatgtccctccgttcttatggaagccgggaaggatctgtatcaagccgttctggagagtgcagtcctgttcctatgggttcatttccaagaagagggtttgtaaatggaagcagagaaagtactggatatttagaagaacttgagaaagagaggtcattgcttcttgctgatcttgacaaagaagaaaaggaaaaagactggtattacgctcaacttcagaatctcactaaaagaatagatagtcttcctttaactgaaaatttttccttacaaacagatatgaccagaaggcaattggaatatgaagcaaggcaaatcagagttgcgatggaagaacaactaggtacctgccaggatatggaaaaacgagcacagcgaagaatagccagaattcagcaaatcgaaaaggacatacttcgtatacgacagcttttacagtcccaagcaacagaagcagagaggtcatctcagaacaagcatgaaaccggctcacatgatgctgagcggcagaatgaaggtcaaggagtgggagaaatcaacatggcaacttctggtaatggtcagggttcaactacacgaatggaccatgaaacagccagtgttttgagttctagtagcacacactctgcacctcgaaggctgacaagtcatctgggaaccaaggtggaaatggtgtattcattgttgtcaatgcttggtactcatgataaggatgatatgtcgcgaactttgctagctatgtctagctcccaagacagctgtatatccatgcgacagtctggatgtcttcctctcctcatccagcttttacatggcaatgacaaagactctgtattgttgggaaattcccggggcagtaaagaggctcgggccagggccagtgcagcactccacaacatcattcactcacagcctgatgacaagagaggcaggcgtgaaatccgagtccttcatcttttggaacagatacgcgcttactgtgaaacctgttgggagtggcaggaagctcatgaaccaggcatggaccaggacaaaaatccaatgccagctcctgttgaacatcagatctgtcctgctgtgtgtgttctaatgaaactttcatttgatgaagagcatagacatgcaatgaatgaactagggggactacaggccattgcagaattattgcaagtggactgtgaaatgtatgggcttactaatgaccactacagtattacactaagacgatatgctggaatggctttgacaaacttgacttttggagatgtagccaacaaggctacgctatgctctatgaaaggctgcatgagagcacttgtggcccaactaaaatctgaaagtgaagacttacagcaggttattgcgagtgttttgaggaatttgtcttggcgagcagatgtaaatagtaaaaagacgttgcgagaagttggaagtgtgaaagcattgatggaatgtgctttagaagttaaaaaggaatcaaccctcaaaagcgtattgagtgccttatggaatttgtcagcacattgcactgagaataaagctgatatatgtgctgtagatggtgcacttgcatttttggttggcactcttacttaccggagccagacaaacactttagccattattgaaagtggaggtgggatattacggaatgtgtccagcttgatagctacaaatgaggaccacaggcaaatcctaagagagaacaactgtctacaaactttattacaacacttaaaatctcatagtttgacaatagtcagtaatgcatgtggaactttgtggaatctctcagcaagaaatcctaaagaccaggaagcattatgggacatgggggcagttagcatgctcaagaacctcattcattcaaagcacaaaatgattgctatgggaagtgctgcagctttaaggaatctcatggcaaataggcctgcgaagtacaaggatgccaatattatgtctcctggctcaagcttgccatctcttcatgttaggaaacaaaaagccctagaagcagaattagatgctcagcacttatcagaaacttttgacaatatagacaatttaagtcccaaggcatctcatcgtagtaagcagagacacaagcaaagtctctatggtgattatgtttttgacaccaatcgacatgatgataataggtcagacaattttaatactggcaacatgactgtcctttcaccatatttgaatactacagtgttacccagctcctcttcatcaagaggaagcttagatagttctcgttctgaaaaagatagaagtttggagagagaacgcggaattggtctaggcaactaccatccagcaacagaaaatccaggaacttcttcaaagcgaggtttgcagatctccaccactgcagcccagattgccaaagtcatggaagaagtgtcagccattcatacctctcaggaagacagaagttctgggtctaccactgaattacattgtgtgacagatgagagaaatgcacttagaagaagctctgctgcccatacacattcaaacacttacaatttcactaagtcggaaaattcaaataggacatgttctatgccttatgccaaattagaatacaagagatcttcaaatgatagtttaaatagtgtcagtagtagtgatggttatggtaaaagaggtcaaatgaaaccctcgattgaatcctattctgaagatgatgaaagtaagttttgcagttatggtcaatacccagccgacctagcccataaaatacatagtgcaaatcatatggatgataatgatggagaactagatacaccaataaattatagtcttaaatattcagatgagcagttgaactctggaaggcaaagtccttcacagaatgaaagatgggcaagacccaaacacataatagaagatgaaataaaacaaagtgagcaaagacaatcaaggaatcaaagtacaacttatcctgtttatactgagagcactgatgataaacacctcaagttccaaccacattttggacagcaggaatgtgtttctccatacaggtcacggggagccaatggttcagaaacaaatcgagtgggttctaatcatggaattaatcaaaatgtaagccagtctttgtgtcaagaagatgactatgaagatgataagcctaccaattatagtgaacgttactctgaagaagaacagcatgaagaagaagagagaccaacaaattatagcataaaatataatgaagagaaacgtcatgtggatcagcctattgattatagtttaaaatatgccacagatattccttcatcacagaaacagtcattttcattctcaaagagttcatctggacaaagcagtaaaaccgaacatatgtcttcaagcagtgagaatacgtccacaccttcatctaatgccaagaggcagaatcagctccatccaagttctgcacagagtagaagtggtcagcctcaaaaggctgccacttgcaaagtttcttctattaaccaagaaacaatacagacttattgtgtagaagatactccaatatgtttttcaagatgtagttcattatcatctttgtcatcagctgaagatgaaataggatgtaatcagacgacacaggaagcagattctgctaataccctgcaaatagcagaaataaaagaaaagattggaactaggtcagctgaagatcctgtgagcgaagttccagcagtgtcacagcaccctagaaccaaatccagcagactgcagggttctagtttatcttcagaatcagccaggcacaaagctgttgaattttcttcaggagcgaaatctccctccaaaagtggtgctcagacacccaaaagtccacctgaacactatgttcaggagaccccactcatgtttagcagatgtacttctgtcagttcacttgatagttttgagagtcgttcgattgccagctccgttcagagtgaaccatgcagtggaatggtaagtggcattataagccccagtgatcttccagatagccctggacaaaccatgccaccaagcagaagtaaaacacctccaccacctcctcaaacagctcaaaccaagcgagaagtacctaaaaataaagcacctactgctgaaaagagagagagtggacctaagcaagctgcagtaaatgctgcagttcagagggtccaggttcttccagatgctgatactttattacattttgccacggaaagtactccagatggattttcttgttcatccagcctgagtgctctgagcctcgatgagccatttatacagaaagatgtggaattaagaataatgcctccagttcaggaaaatgacaatgggaatgaaacagaatcagagcagcctaaagaatcaaatgaaaaccaagagaaagaggcagaaaaaactattgattctgaaaaggacctattagatgattcagatgatgatgatattgaaatactagaagaatgtattatttctgccatgccaacaaagtcatcacgtaaagcaaaaaagccagcccagactgcttcaaaattacctccacctgtggcaaggaaaccaagtcagctgcctgtgtacaaacttctaccatcacaaaacaggttgcaaccccaaaagcatgttagttttacaccgggggatgatatgccacgggtgtattgtgttgaagggacacctataaacttttccacagctacatctctaagtgatctaacaatcgaatcccctccaaatgagttagctgctggagaaggagttagaggaggggcacagtcaggtgaatttgaaaaacgagataccattcctacagaaggcagaagtacagatgaggctcaaggaggaaaaacctcatctgtaaccatacctgaattggatgacaataaagcagaggaaggtgatattcttgcagaatgcattaattctgctatgcccaaagggaaaagtcacaagcctttccgtgtgaaaaagataatggaccaggtccagcaagcatctgcgtcttcttctgcacccaacaaaaatcagttagatggtaagaaaaagaaaccaacttcaccagtaaaacctataccacaaaatactgaatataggacacgtgtaagaaaaaatgcagactcaaaaaataatttaaatgctgagagagttttctcagacaacaaagattcaaagaaacagaatttgaaaaataattccaaggtcttcaatgataagctcccaaataatgaagatagagtcagaggaagttttgcttttgattcacctcatcattacacgcctattgaaggaactccttactgtttttcacgaaatgattctttgagttctctagattttgatgatgatgatgttgacctttccagggaaaaggctgaattaagaaaggcaaaagaaaataaggaatcagaggctaaagttaccagccacacagaactaacctccaaccaacaatcagctaataagacacaagctattgcaaagcagccaataaatcgaggtcagcctaaacccatacttcagaaacaatccacttttccccagtcatccaaagacataccagacagaggggcagcaactgatgaaaagttacagaattttgctattgaaaatactccggtttgcttttctcataattcctctctgagttctctcagtgacattgaccaagaaaacaacaataaagaaaatgaacctatcaaagagactgagccccctgactcacagggagaaccaagtaaacctcaagcatcaggctatgctcctaaatcatttcatgttgaagataccccagtttgtttctcaagaaacagttctctcagttctcttagtattgactctgaagatgacctgttgcaggaatgtataagctccgcaatgccaaaaaagaaaaagccttcaagactcaagggtgataatgaaaaacatagtcccagaaatatgggtggcatattaggtgaagatctgacacttgatttgaaagatatacagagaccagattcagaacatggtctatcccctgattcagaaaattttgattggaaagctattcaggaaggtgcaaattccatagtaagtagtttacatcaagctgctgctgctgcatgtttatctagacaagcttcgtctgattcagattccatcctttccctgaaatcaggaatctctctgggatcaccatttcatcttacacctgatcaagaagaaaaaccctttacaagtaataaaggcccacgaattctaaaaccaggggagaaaagtacattggaaactaaaaagatagaatctgaaagtaaaggaatcaaaggaggaaaaaaagtttataaaagtttgattactggaaaagttcgatctaattcagaaatttcaggccaaatgaaacagccccttcaagcaaacatgccttcaatctctcgaggcaggacaatgattcatattccaggagttcgaaatagctcctcaagtacaagtcctgtttctaaaaaaggcccaccccttaagactccagcctccaaaagccctagtgaaggtcaaacagccaccacttctcctagaggagccaagccatctgtgaaatcagaattaagccctgttgccaggcagacatcccaaataggtgggtcaagtaaagcaccttctagatcaggatctagagattcgaccccttcaagacctgcccagcaaccattaagtagacctatacagtctcctggccgaaactcaatttcccctggtagaaatggaataagtcctcctaacaaattatctcaacttccaaggacatcatcccctagtactgcttcaactaagtcctcaggttctggaaaaatgtcatatacatctccaggtagacagatgagccaacagaaccttaccaaacaaacaggtttatccaagaatgccagtagtattccaagaagtgagtctgcctccaaaggactaaatcagatgaataatggtaatggagccaataaaaaggtagaactttctagaatgtcttcaactaaatcaagtggaagtgaatctgatagatcagaaagacctgtattagtacgccagtcaactttcatcaaagaagctccaagcccaaccttaagaagaaaattggaggaatctgcttcatttgaatctctttctccatcatctagaccagcttctcccactaggtcccaggcacaaactccagttttaagtccttcccttcctgatatgtctctatccacacattcgtctgttcaggctggtggatggcgaaaactcccacctaatctcagtcccactatagagtataatgatggaagaccagcaaagcgccatgatattgcacggtctcattctgaaagtccttctagacttccaatcaataggtcaggaacctggaaacgtgagcacagcaaacattcatcatcccttcctcgagtaagcacttggagaagaactggaagttcatcttcaattctttctgcttcatcagaatccagtgaaaaagcaaaaagtgaggatgaaaaacatgtgaactctatttcaggaaccaaacaaagtaaagaaaaccaagtatccgcaaaaggaacatggagaaaaataaaagaaaatgaattttctcccacaaatagtacttctcagaccgtttcctcaggtgctacaaatggtgctgaatcaaagactctaatttatcaaatggcacctgctgtttctaaaacagaggatgtttgggtgagaattgaggactgtcccattaacaatcctagatctggaagatctcccacaggtaatactcccccggtgattgacagtgtttcagaaaaggcaaatccaaacattaaagattcaaaagataatcaggcaaaacaaaatgtgggtaatggcagtgttcccatgcgtaccgtgggtttggaaaatcgcctgaactcctttattcaggtggatgcccctgaccaaaaaggaactgagataaaaccaggacaaaataatcctgtccctgtatcagagactaatgaaagttctatagtggaacgtaccccattcagttctagcagctcaagcaaacacagttcacctagtgggactgttgctgccagagtgactccttttaattacaacccaagccctaggaaaagcagcgcagatagcacttcagctcggccatctcagatcccaactccagtgaataacaacacaaagaagcgagattccaaaactgacagcacagaatccagtggaacccaaagtcctaagcgccattctgggtcttaccttgtgacatctgtttaaaagagaggaagaatgaaactaagaaaattctatgttaattacaactgctatatagacattttgtttcaaatgaaactttaaaagactgaaaaattttgtaaataggtttgattcttgttagagggtttttgttctggaagccatatttgatagtatactttgtcttcactggtcttattttgggaggcactcttgatggttaggaaaaaaatagtaaagccaagtatgtttgtacagtatgttttacatgtatttaaagtagcatcccatcccaacttcctttaattattgcttgtcttaaaataatgaacactacagatagaaaatatgatatattgctgttatcaatcatttctagattataaactgactaaacttacatcagggaaaaattggtatttatgcaaaaaaaaatgtttttgtccttgtgagtccatctaacatcataattaatcatgtggctgtgaaattcacagtaatatggttcccgatgaacaagtttacccagcctgctttgctttactgcatgaatgaaactgatggttcaatttcagaagtaatgattaacagttatgtggtcacatgatgtgcatagagatagctacagtgtaataatttacactattttgtgctccaaacaaaacaaaaatctgtgtaactgtaaaacattgaatgaaactattttacctgaactagattttatctgaaagtaggtagaatttttgctatgctgtaatttgttgtatattctggtatttgaggtgagatggctgctcttttattaatgagacatgaattgtgtctcaacagaaactaaatgaacatttcagaataaattattgctgtatgtaaactgttactgaaattggtatttgtttgaagggtcttgtttcacatttgtattaataattgtttaaaatgcctcttttaaaagcttatataaatttttttcttcagcttctatgcattaagagtaaaattcctcttactgtaataaaaacaattgaagaagactgttgccacttaaccattccatgcgttggcacttatctattcctgaaatttcttttatgtgattagctcatcttgatttttaatatttttccacttaaacttttttttcttactccactggagctcagtaaaagtaaattcatgtaatagcaatgcaagcagcctagcacagactaagcattgagcataataggcccacataatttcctctttcttaatattatagaattctgtacttgaaattgattcttagacattgcagtctcttcgaggctttacagtgtaaactgtcttgccccttcatcttcttgttgcaactgggtctgacatgaacactttttatcaccctgtatgttagggcaagatctcagcagtgaagtataatcagcactttgccatgctcagaaaattcaaatcacatggaactttagaggtagatttaatacgattaagatattcagaagtatattttagaatccctgcctgttaaggaaactttatttgtggtaggtacagttctggggtacatgttaagtgtccccttatacagtggagggaagtcttccttcctgaaggaaaataaactgacacttattaactaagataatttacttaatatatcttccctgatttgttttaaaagatcagagggtgactgatgatacatgcatacatatttgttgaataaatgaaaatttatttttagtgataagattcatacactctgtatttggggagggaaaacctttttaagcatggtggggcactcagataggagtgaatacacctacctggtgccttgaaaatcacatcaagtagttaattatctaccccttacctgtgtttataacttccaggtaatgagaatgattttttttaaagctaaaatgccagtaaataaaagtgctatgacttgagctaagatatttgactccaatgcctgtactgtgtctactgcaccactttgtaaacacttcaatttactatctttgaaatgattgacctttaaatttttgccaaatgttatctgaaattgtctatgaataccatctacttctgttgttttcccaggcttccataaacaatggagatacatgcaaaaaaaaaaa

SEQ ID NO: 503 - DNA, 1216 bp, Human
ctcattgacttccttcctgttctaactgccagtactcagaagtcagagttgagagacagaggcaccccggacagagacgtgaagcactgaataaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaagtgaacagggatattgtgtcaggcctgaaatacgttcagcacacctacaggactggggtgaaagtggataaagcaacatttatggttggcagctatggacctcggcctgaggagtatgagttcctcactccagttgaggaggctcccaagggcatgctggcgcgaggcacgtaccacaacaagtccttcttcaccgacgatgacaagcaagaccacctcagctgggagtggaacctgtcgattaagaaggagtggacagaatgaatgcatccacccctttccccacccttgccacctggaagaattctctcaggcgtgttcagcaccctgtccctcctccctgtccacagctgggtccctcttcaacactgccacatttccttattgatgcatcttttcccaccctgtcactcaacgtggtccctagaacaagaggcttaaaaccgggctttcacccaacctgctccctctgatcctccatcagggccagatcttccacgtctccatctcagtacacaatcatttaatatttccctgtcttacccctattcaagcaactagaggccagaaaatgggcaaattatcactaacaggtctttgactcaggttccagtagttcattctaatgcctagattcttttgtggttgttgctggcccaatgagtccctagtcacatcccctgccagagggagttcttcttttgtgagagacactgtaaacgacacaagagaacaagaataaaacaataactgtgtgtgttctggctgag

SEQ ID NO: 504 - DNA, 4570 bp, Human
gtcacttccggcgggggcgcggcttggactgaggagcggacccggccgggcgcaggggctggactggcggagcaggtggggtccgcggccgccggagcgttccggtcggcgtctgggcatctcggcctcggcagaaagcgcgaccgccctgctgcgcggggcccgcggcgatgccgttcctgcacggcttccggaggatcatcttcgagtaccagccgctggtggatgcgattctgggctccctggggatccaggaccccgagcggcaggagtctctggaccggcccagttatgtcgccagcgaggagagccgaatccttgttctcactgagctgctggagaggaaagcccactctcccttttaccaggaaggcgtgagcaacgccctgctcaagatggctgagctggggctgacgcgggcggccgacgttctcttgcggcatggggccaatctcaactttgaagacccagtcacctactacacggccttgcacatcgccgtcctgcggaaccagccggacatggtggagctgctggtgcatcacggggccgacgttaatcggagggaccggatccacgagagtagccccttggacctggccagcgaggagcctgagcgcctgccctgcctgcagcgcctcctggaccttggagctgatgtcaatgccgctgacaagcatggggcagacgtcaaggccaccaccaaagatggggacacagtgttcacctgcatcatcttcctgcttggtgagaccgtgggaggggacaaagaggaggcccagatgatcaaccgcttctgcttccaagtcacacggctgctgctggcacacggggccgaccccagcgagtgcccagcccacgagtccctcacccacatctgcctgaagagctttaaactgcacttccctctcctgcgcttcctcctggagtccggagccgcctacaactgctccctgcacggtgcgtcctgctggtctggctttcacatcatctttgagaggctctgttcccacccaggctgcacggaagacgagagccatgcggacctcctgcgcaaagctgagactgtcctggatctcatggtgaccaactctcagaaactccagctgcccgaaaacttcgatatccaccctgtgggcagcctggcggaaaagatccaggccctccacttctccttgaggcagctggagagctatcccccgcccctcaagcacctgtgccgtgtggccatccggctctaccttcagccgtggcctgtggatgtgaaggtcaaagccctgcctctgcccgacaggctgaagtggtacctccttagcgagcacagtggctccgtggaagatgacatctgataggtctcaggctacaggaacgggggacacgggcagctcaggtcagcctgttggtagatgctgggacagcattagaagagggtctttttgatctgggagatgagacgggatccttcatgagaaaagccagccaggtagagcctgaagctgtgatcactccagtggtgaagggtgcagctctggttcttccagagagactgcccccttccctccagcggcactccaagtcccccccatgttggaaagaggaacagggcttggattgatgtttataccctctgaattggagggcagtgccagggcatttgcagaagctgggaaggaccaagcctcagcaccccagggctgcggggctcttgttggccgcacgtggcagtgcagctggagaggaagcctggggcacgtcctgtgcggtgccaccaaggccccacccctgccccttttccttccaggttctgttactcacagaagtgtttctggtgggctctgcgggagaagacactaagggccccacaggcttgtttcatggtgttgcaagccaagctggcccctgcctgttcctgtagctctggggccaggtcagccgtggccccacctaccagaactgtgctctgctggcagctgtgcttttgccaaacccagggcctcagcgaccatgacttctgctaaaaagcaatcatgagtgcgtggctggggacagacctctctgaagtgtctcctgttgtgaggggctcactttggagccactgaagagccgactgtgccacccacttgcgagcctcagtcccttccaagctgcactggtcattgggaattgtgtaaacacctctggggataagctgaggtgactaaatgatatatttatattataagattaaactgactttcttggccttaacaaggtccttatataaaatttccaccccgcccctccatagttcaggatagaggctcccacagcagccggtaaggaagtgggtggcaggtgtgaggggatgctgtgtttggggggttgtttccaagtccctgcaaagaagcaccactctagactggcaagggcctccacagtgtggaggtcccattttattatttttttttttcgagacactctgtcacccaggctggagtgcaatggtgcaatctcggctcactgcgacctctgcctcccaggttcaagcagttctcctgcctcagcctcctgagtagctggcattataggtgcccaccaccatgcctggctgatttttgtatttttagtagagacggggtttcgccatgttggtcaggctggtctcaaactcctgacctcaggtgattcgcctgcctcggcctttcaaagtgctgggattacagacatgagccactgtgcccggcccccattttattttagttttattttgagacagagtctcgctctgtcacctaggctggagtgcagtggcgcaatctcacctcactgcaagctctgcctcccgggctcaccccattctcctgcctcagcctcctgagtagctgggactacaggcgcccgccatcacgcctggctaattttttttttttttgtattttaagtagagacggggtttcacctgttagccaggatggtctcaatctcctgacctcgtgatctgcccgcctcggcctcccaaagtgctgggattacaggcgtgagccaccgcgcccagccccattttattttttactttaaatgcctgccaaggagcagcctcaagcccagagaagactgaggctacggggaacttcccttgctgcaggctgttgtaacactttaagggccccaggtctccactgccaagcaggacttggcacatgagcacccaccccacagcaccatcaggcagcacccatgggctccaccagcccagctctgtccctcccctaggtaaagatcacactgaagtcttcaagtccccagcaaccaagttgggggtggtttccttcctcttcaggcagccaggcccatggctggaaggccgggctggaggcccagggaatcggttactgatgtggccaccctattcccacatggggagcaccaggagccctggagccccttccacccaatcccatctcgcaggagagcagggtctgggctcctgcctcaccgctggttcagcagcaccctccccgccgggtcccaccttgccttttgaagaagagcccgcataatgagtggacggcagacagctatatttagtggtgcctcgacactcacgaaccgccagcgtggcgcctggatcttgcccagctgccagctccccccaccaggactgtggttcctcagtttctcctgccagccccggctcatctcagggcaaagctatagacatggtagatctcatcggggaggttctcctgcctctcctcggccaggaggctgaggcctgcactgcagatgatcctgcggaccacgtcaaggtcccggcacacgctgctgtccacgtcgtccagaatcacgccctcctgggccatgttgtctttgatgacgatgatgccgttggggcggaggctgcccttgcagcgccgcaggaactcggccaggtgctgatcggtgaggtggcctggggagggcagaggcaaggttaccagggcaccatgcaagcggatgtcggcactggatgggatgtacttctcagccccgctgagcccctcatttgtgcccagcattttgtgtgcacacatggcctcattggctctcagtcccgagagatttactaaaccccaattcatagaataggaaactgtggctcagaggtcatctacctaaagacacattaagccagaatttgacttgacgggatggcttacaagtcctgcctgatacctacacaccatgatgccccacccctgccaggcttggatcggaggagtgaacctgggctaagagtttggcattgcaggagctcccagagagactgccttccctacactagaagtccccacaaaggcttctgagaccacaaaatacaaggccagacctagagtgtccacagcaggcctgtgctgcccgcctcaggaggtggccgactgctgctagcggcctgccgccacgtcagcagcccagggcacagcgctcgaggtgtgctgttaggctaagagggtgcagggctagacacgaagcttaaactattcatcttattaaaaataaaacccttataaaactccaaaaaaaaaaaaaaaaaaaaaaaaaaaaaaaaaaa

SEQ ID NO: 505 - DNA, 709 bp, Human
cagacgtccctgcgcgtcgtcctcctcgccctccaggccgcccgcgccgcgccggagtccgctgtccgccagctacccgcttcctgccgcccgccgctgccatgctgcccgccgcgctgctccgccgcccgggacttggccgcctcgtccgccacgcccgtgcctatgccgaggccgccgccgccccggctgccgcctctggccccaaccagatgtccttcaccttcgcctctcccacgcaggtgttcttcaacggtgccaacgtccggcaggtggacgtgcccacgctgaccggagccttcggcatcctggcggcccacgtgcccacgctgcaggtcctgcggccggggctggtcgtggtgcatgcagaggacggcaccacctccaaatactttgtgagcagcggttccatcgcagtgaacgccgactcttcggtgcagttgttggccgaagaggccgtgacgctggacatgttggacctgggggcagccaaggcaaacttggagaaggcccaggcggagctggtggggacagctgacgaggccacgcgggcagagatccagatccgaatcgaggccaacgaggccctggtgaaggccctggagtaggcgagccagccgccaaggttgacctcagcttcggagccacctctggatgaactgcccccagcccccgccccattaaagacccggaagcctgaaaaaaaaaa

SEQ ID NO: 506 - DNA, 556 bp, Human
tgacccacttccgttacttgctgcggaggaccgtgggcagccagggtcggtgaaggatcccaaaatggctgggcgaaaacttgctctaaaaaccattgactgggtagcttttgcagagatcataccccagaaccaaaaggccattgctagttccctgaaatcctggaatgagaccctcacctccaggttggctgctttacctgagaatccaccagctatcgactgggcttactacaaggccaatgtggccaaggctggcttggtggatgactttgagaagaaggtgaaatcttgtgctgagtgggtgtctctctcaaaggccaggattgtagaatatgagaaagagatggagaagatgaagaacttaattccatttgatcagatgaccattgaggacttgaatgaagctttcccagaaaccaaattagacaagaaaaagtatccctattggcctcaccaaccaattgagaatttataaaattgagtccaggaggaagctctggcccttgtattacacattctggacattaaaaataataattatacagttaaaaaa

SEQ ID NO: 507 - DNA, 1422 bp, Human
ggctcgcctgggagctcatacctggctagggccgaggattggctgttccggggctagggagcgctttctcccgggaaccgcggctgtgacccaagtggcccggaccagtttggggctgcgtgcggcctgcctcaagcaaccaggtacgtaggtcggcggcccagctcggcgctgcggtgggagccggagggcgacagtcagagccggggtgccagcgggacgcgaccgccagatccacttaggaccccgtcgttctgcgaagcggccacgtctgagtcccggggcctcctcgtgctgcagatgtcgccttaggacctcggccaggataccctctgccatgctcttgtgctgcccgtgatcaccgactggcccttgtaagcaccttcgcagcaggaagcccagagctgcgcctgccctttctgaaggctgtggaagaggttggagtgggcgcatcttagcttgccccatccccatttgaggtctgtcggagctgcccttcagtgtgagcatccacaatgggtaccccagcctcggtggtcagtgagccacccccttggcaggccccgattgaggcccggggccgcaagcaggcctcggccaacatcttccaggacgccgagctgctgcagatccaagccctgtttcaacgcagcggggaccagctggccgaggaacgggcacagatcatctgggaatgtgcaggggaccaccgtgtggctgaggccctcaagaggctgcgcaggaagaggcccccaaggcagaaacccctgggccactcgctacaccactgcagccgcctcagaatcctggagccccactctgcactggccaacccacagagtgccacagagacagcctccagtgagcagtatctgcactctaggaagaaaagtgccaggatccgccggaactggaggaagtcaggccccacaagctacctccaccagatcagacactgatccagggaaagagccaggaatggcagtgtcttccctcttgccaaaaggcctggggaggtgaaggaagagagactttaggcaagcagcccaaaggggtaaatgaaagcaagaggctgctgccactgacctgctccattcagaacaagactggatgcttctgttgagctctccattatgtgggacccattcctcaccaaaatgaggagagacagtgactgttcctgccacagtccttcccagtctaacactattcctgggctgcatgatattcccctgggagcaaagtgacaggcacttagatgcagcatttcaccactcatgctactaatcatctacctgctactactgtaaaccatggttccagcagcctgttccacacccccacaccatcaggatagcacagggaaactgtagtttaagtggcaaataaaaacatttgcatcaaaaaaaaaaaaaaaaaaaa

SEQ ID NO: 508 - DNA, 1383 bp, Human
gccgaagcggcgggatgagcggagccggcgtgggcggggcgtccgaggagagccaggccatgcaggcccacgtgtctattatcctcccagtccacaacgctgaaccgtggctggacgaatgtttgaggtctgttttgcaacaggactttgaaggtaccatggagctgtctgttttcaatgatgccagtaaggacaagtctggggctatcattgaaaaatggagagtgaagctggaagattctggtgtccacgtgatcattggggggcacgattctccctctcctagaggcgtcggatacgctaaaaatcaagcagttgcccagagctcagggtcttacctttgctttttggattcggatgacgtcatgatgccccagcgggtgaggctgcaacacgaggctgccgttcagcacccgtcgagcatcattggttgcagagtgaggagagatccccctaactccaccgaacgatacacacgttggatcaaccagctgacgccggagcagctcctaacccaggttttcacctcaaatggccccacggtgatcatgcccacctggttctgctcgcgagcgtggttctcccacgtgggcccctttaacgagggaggtcagggcgtcccggaggacctgctgttcttctacgagcacctcaggaagggcggcggcgtcatccgcgtggaccagagtctcctgctgtatcgccaccacccacaggcggccacgcactgcgtcctcgagacgaccatctggacccaccgcgtccgcttcctggaagagcaggccctgccccgctgggcggccttcaccatctggaacgctggcaagcaggggcgccggctgtaccgcagcttgactgccggcagccagcgcaaggtggtggcattctgtgacgtggacgagaacaagatcaggaaaggcttctattgccacgaggactctcaggaaagacccaagccccgaatccccatcctgcacttccgagccgcccggccacccttcgtcatctgcgtgaagctggacctcacagggggcgcctttgaggacaacctgaggtcactgcacttgcaggagggccaggacttccttcacttcagctgacggacccatggcagctgctcccagtgcatcccaggccagcaggagctttgtgagctgcaggcatggcgatggtgcgcctgttccacacccagcaggcgcaaccagagtctcgtgtgtgccgaccacaggagccaagccttttccactgtgtggactcatgtggccaaggctaggcctggtcacccaggaccctcaccacgtgaccccagccaatcgggacagttcaaggaggaggagacccctattacacaggttggaataaaatatttaaatctcgtaaaaa

SEQ ID NO: 509 - DNA, 1791 bp, Human
ctacgtgagtgccggaccgctgagtggttgttagccaagatggcggtagcgatcgctgcagcgagggtctggcggctaaaccgtggtttgagccaggctgccctcctgctgctgcggcagcctggggctcggggactggctagatctcacccccccaggcagcagcagcagttttcatctctggatgacaagccccagttcccaggggcctcggcggagtttatagataagttggaattcatccagcccaacgtcatctctggaatccccatctaccgcgtcatggaccggcaaggccagatcatcaaccccagcgaggacccccacctgccgaaggagaaggtgctgaagctctacaagagcatgacactgcttaacaccatggaccgcatcctctatgagtctcagcggcagggccggatctccttctacatgaccaactatggtgaggagggcacgcacgtggggagtgccgccgccctggacaacacggacctggtgtttggccagtaccgggaggcaggtgtgctgatgtatcgggactaccccctggaactattcatggcccagtgctatggcaacatcagtgacttgggcaaggggcgccagatgcctgtccactacggctgcaaggaacgccacttcgtcactatctcctctccactggccacgcagatccctcaggcggtgggggcggcgtacgcagccaagcgggccaatgccaacagggtcgtcatctgttacttcggcgagggggcagccagtgagggggacgcccatgccggcttcaacttcgctgccacacttgagtgccccatcatcttcttctgccggaacaatggctacgccatctccacgcccacctctgagcagtatcgcggcgatggcattgcagcacgaggccccgggtatggcatcatgtcaatccgcgtggatggtaatgatgtgtttgccgtatacaacgccacaaaggaggcccgacggcgggctgtggcagagaaccagcccttcctcatcgaggccatgacctacaggatcgggcaccacagcaccagtgacgacagttcagcgtaccgctcggtggatgaggtcaattactgggataaacaggaccaccccatctcccggctgcggcactatctgctgagccaaggctggtgggatgaggagcaggagaaggcctggaggaagcagtcccgcaggaaggtgatggaggcctttgagcaggccgagcggaagcccaaacccaaccccaacctactcttctcagacgtgtatcaggagatgcccgcccagctccgcaagcagcaggagtctctggcccgccacctgcagacctacggggagcactacccactggatcacttcgataagtgagacctgctcagcccacccccacccatcctcagctaccccgagaggtagccccactctaaggggagcagggggacctgacagcacaccactgtcttccccagtcagctccctctaaaatactcagcggccagggcggctgccactcttcacccctgctcctcccggctgttacattgtcaggggacagcatctgcagcagttgctgaggctccgtcagccccctcttcacctgttgttacagtgccttctcccaggggctgggtgagggcacattcaggactagaagcccctctgggcatggggtggacatggcaggtcagcctgtggaacttgcgcaggtgcgagtggccagcagaggtcacgaataaactgcatctctgcgcctggctctctaccaaaaaaaaaaaaaaaaaa

SEQ ID NO: 510 - DNA, 6054 bp, Human
attccccctcctcccccgggagcggcggcggcggccgggccggggccccagcgcgggccgggagggggcacggcggaggccacggaggcaggcgcgggagaagaccgcgctccgcttcccgggccgcgccgacctgctcggcggcctgcccgcccgcgcccaggggccccgaacggtggggccgggcaggcggctgaggcctgtcccctcagttcccaggtgccatgaggaagcctcgtcggaagtcccggcagaatgccgagggccggcgttccccgtccccctacagtctcaagtgctcacccacccgggagaccctgacatatgcccaggcccagcggattgtcgaggtagacattgatggacgcctgcatcgtatcagcatctatgacccactcaaaatcattactgaagatgagctaactgcccaggatatcaccgaatgcaatagtaacaaggaaaacagtgaacagcctcagttccctggcaagtccaagaaaccctcatccaagggcaaaaagaaggaatcctgctccaagcatgcatctggtacttccttccacctcccacagcccagcttccgtatggtggactcaggcatccagccagaagcacccccgctgcctgctgcctactaccgctacattgagaagccacctgaagacctggatgcagaggtagagtatgacatggatgaggaggaccttgcctggctggacatggtgaatgaaaaacggcgagtagatgggcacagtttggtgtctgcagatacctttgagctgctggtagaccggcttgagaaagagtcatacttggagagtcgcagcagtggggcccaacagtcactcatcgatgaagacgctttctgctgtgtgtgcctggatgatgaatgtcacaatagcaatgttattctcttctgtgacatctgcaacctggctgtacaccaggagtgctatggcgtcccatacatccctgagggccagtggctatgccgctgctgcctgcagtctccctcccggcctgtggattgcatcctttgccccaataagggtggcgccttcaaacagaccagtgatgggcactgggcccatgtggtgtgtgccatctggatccctgaagtctgctttgctaacaccgtgttcttggaacctattgagggcattgacaatatcccgcctgcccgctggaaactaacctgctatatctgcaagcagaaagggctaggtgcagccatccagtgccataaggtgaactgctacacagcattccatgtgacatgtgcacagcgggctgggctcttcatgaagattgagcccatgcgcgaaaccagcctcaatggcaccatctttacagtgcgcaagactgcctactgtgaggcccactcgccaccaggtgcggccactgctaggaggaagggcgactcccctagaagcatcagtgagactggcgatgaggaagggctgaaggagggtgatggagaggaggaagaagaggaagaggtggaggaagaagagcaggaagctcaaggcggggtgagtggctccctcaagggagtgcccaagaaaagcaagatgagtttgaagcagaagatcaagaaggagccagaggaagcaggccaagacacaccctccactctccccatgcttgctgtcccacagataccctcttacaggttgaacaagatctgtagtggtctctcctttcagaggaaaaaccagtttatgcagcggcttcacaattattggctgttgaagcggcaggcacggaatggtgtccctcttatccggcgcttgcactcccatctgcagtcccaaagaaacgctgagcagcgagagcaggatgagaagacaagtgcagtgaaggaggagctgaagtattggcagaagctccggcatgacttggagcgggcgcggctgctgattgagctgattcggaagagagagaagctcaaacgagagcaggtcaaagtccagcaggctgccatggagctggagctgatgccattcaatgttctgttgaggacaacactggacctgctgcaggagaaggatcctgcacacatcttcgcagaaccagtcaacttgagtgaggttccagattacctggaattcatatccaagccaatggatttttctactatgaggcggaagctggagtcccacctgtaccgcaccttggaggagtttgaggaggactttaaccttatagttaccaactgcatgaagtataatgctaaagacacaattttccaccgagcagctgtccgcctgcgggacctgggaggggccatcctacggcacgcccggcggcaggcagagaacatcggctatgaccccgagaggggcactcacctgcccgagtcacccaaattggaagacttttaccgcttctcctgggaagacgtggacaacatcctcatcccagagaaccgggcccatttgtccccagaggtgcagctgaaggagctgctggagaaactggacctggtgagcgccatgcggtccagtggggcccgcacccgtcgtgtccgcctgctacgccgggagatcaatgcccttcggcagaagctggcacagccaccaccaccacagccaccatcactcaacaagacagtatccaatggggagctgccagcagggccccagggggatgcagctgtgctggagcaggccttgcaggaggagccagaagacgatggggacagagatgactccaaactgcctcctccgccaaccctggagcccactgggcctgcaccttccttgtctgagcaagaatcccccccggagccccctactctgaaacccattaatgatagcaaacctccaagcaggttcctaaagcccagaaaggtggaagaagatgagctcttggaaaaatcaccactgcagctagggaatgagcctttgcaacgcttgctcagtgacaatggcatcaacagactatccctcatggcccctgacaccccggccggtaccccacttagtggtgtgggtcgccgcacatcagtcctcttcaagaaggccaagaatggggttaagctacagagaagcccagacagggtcctggagaatggcgaggaccatggtgtggcaggctctcctgcctctccagccagcatcgaggaagagcgccactcccggaagcggccaaggagcaggagctgtagtgagagcgaaggggagaggtccccccagcaggaggaagagacaggcatgaccaacggctttggaaaacacaccgaaagcgggtctgactctgaatgtagtttgggtctcagtggtggactggcatttgaagcttgcagtggtctgacgccccccaaacgcagccgtgggaagccagccctgtctcgagtgcccttcctggaaggtgtgaacggagactctgactacaatggctcaggcagaagcctcctgctgccctttgaagaccgcggagacctggagcccttggagctggtgtgggccaagtgccgaggctacccctcctaccctgccttgatcatcgatcccaagatgccccgggagggcctcctgcacaatggcgttcccatccctgtccccccgctggacgtgctgaagctgggagagcagaaacaggcagaggctggagagaagctcttccttgtcctcttctttgacaacaagcgcacctggcagtggcttccaagggacaaagtcctgcccttgggtgtggaagacaccgtggacaagctcaagatgctggaaggccgcaagaccagcatccgcaagtcagtgcaggtggcctatgaccgtgcgatgatccacctgagcagagtccgggggccccactccttcgtcacttccagctacctgtaagggcagggctgggcctgcatccgcttgccctgcctccatcccgcagggcacagagaagcctcttctgcccctgccagatgtatggccggcagcttccccctctcatggtaggccagggactgggctttctccccactaagggcaaggccccagttttgaccaatcgcatggttctcctggcaggcctgctgtgtgccaaaaactcccacccaaggtccctcaggggatatttcactgaagaaccagttagaagtagaaacagctgtggggcttgggcccagcttaggagattgcccagatggcaagaggtcctgggctccttcttgaggggctgcctggcccgctccatcctactcccactaactacacctcagggcgggtgaggttccgacactgatcccagagatgccgtggatacgccagggtcccagggggaatctccccaagctcacactctctcccgcttatcgcctattctcacacctcttctcggtcccatcttctgcacccattgcccagtcttgctttctctttcccatattccttttctttttctcttgtgccaaactgacagaaaccgtcaccacactggtctttttctttaatgtctcattccccttgaggccagctgctatgccaggtggtgtctctgccaggctcctcaggcccagacagaggccagcccacaacctatgaccccctcccccaggacaccacctcccacccacagaccttccctttagctgttgacacaacttcccagctctgcaagtgtgccccctggatcaaggcgggtcccctcttgtttttttctttgctgccacgaggtggtccaagccttcagggtgggctcctatcaggctgggtgtgcgagtgtccatctgtccacatggatgtcgagggtggtttgtgtggagctgtgctcgtcagctgggtctgccctcttcccccttttctccttcttctctcctcatggactttttctgcaattgcagtcttaagcttcactctccaccacctggatggcatggcgcctgccaccaaacatcttcctggcctgcgctctgccctgccctgcctagcctctgctactcccacttcccaactccagggaatgcattacttttatttcaaaccctctgcctccttccttctttctcttcaaccccctccccaccttcaccttctcaaaaatggaaggaaaaaaaaactgtgaatggggaatgctgactgacaaaccaacacaactttcagaggcttcagtgtctgttctctggacatttcttttcacctcctgagcaccaaagtcgcagggccagttgcaggccgctgattgccatgttgatttttaacctgatattctttttaattgttttaaatttttcataggggagttttggacaaaacagtcactggggagatcactgccatttttacacacttgactttttaaaaatacaaccaaccaaccaccacaacttcttatacatttgggacatgagccagagtttaaaagggaaccaacaaaacactataacttaaaaggatggggttttggattttgtataataataaaaacaatacagcatatggctagggaaggacatggtgtatataattgtaaaatactgttctaaattattcaggcctatagtttccattactggagtcctccattgtgtggccacacagtgtcgttgatttaaaggagccagtgcttcccctctccccaggtagttggtcagctgtggactctgtgacctttgtctaaacctgtgttgtaagatcttgggacttcctctctttctatgtctatctcttccccccaacactttctcttcttagtctctctctttatttttcaatctctgaatattttagtctctctctgagtctcattttttaaaatgctcttttagaacgggaaacggctcagatcctgctgtggcacggggcctatgtgtctctgtcgcgtctgctgtgaagcacatgatgctctatttattgtagagagtgactttatttgctttctagaattgtttataacagatggtataagagaggtaataaacagagaaaaatctatgcttgtaaagaatacaaaagttaattttacctactataatatgactgtctgaaacttattttctctctgagaaataaatgttctaatgggcagtaaaaaaaaaaaaaaaaaaaaaaaaaaaaaaaa

SEQ ID NO: 511 - DNA, 984 bp, Human
actagttgatgacgcacccatggcgcctggttgtctagacgagccggtgtaccgactccccggtggatgataactatgagtgcaaaagcaagacgcgcactttcctgtcacctcgccctttcaccccctcgggaagatcaaagtgtctttagcccaagcatggccttgagcgacttcatcacacctgcatgaggtcacaagcagtcactagcgcaggggggtgaggcgagttctgggtgaaagaaacggggcggggctgaggccaaggaagaggttggactgtgtctcgcatgctcctgacgcagaaggttttgaaccttttttcacctcgtctgaaatggctgcctcccagtgtctctgctgctcaaaatttctcttccagagacagaacctcgcctgtttcctcacaaacccacactgtggcagccttgttaatgcagatggccatggtgaagtgtggacagattggaataatatgtccaagtttttccagtatggatggcgatgcaccactaatgagaatacctattcaaaccgtaccctgatgggcaactggaaccaggaaagatatgacctgaggaatatcgtgcagcccaaacccttgccttcccagtttggacactactttgaaacaacatatgatacaagctacaacaacaaaatgccactttcaacacatagatttaagcgagagcctcactggttcccaggacatcaacctgaactggatcctccccgatacaaatgcacagaaaagtcaacttacatgaatagctattcaaagccttaaattgggcatcactcaggatgtgtataagatcttaatattgactagtttcacatccaggtttctaagaaatgataagatacttcacttttccagagtgaaatgtaggagggagcacattctaagtacagctaaaaatttagctcactgtaacacagtttcactctctgaataaataaagcaaaaaacacagtaaa

SEQ ID NO: 512 - DNA, 2004 bp, Human
gccccggattgagccctccccgcccgggctcccgacgcgccgaggtctcggggaggcccggacgcgccggtcgcaggcccggccggcgagcggcgggcgggcggcggggagggggctgcgcggggcgggcggcgggcccggcgctattccggccaggaggcgggaggcggttgccggctgcgcgccgaagcctgcgcgccagtcctccggccactgctatcgcccacggccgcaccatggccctaaaggccgagggcgccgcactcgactgcttcgaggtgacgctgaaatgcgaggaaggggaggacgaggaggaggccatggtggtggccgtaattccgcggcccgagccgatgctcagagtgacccaacaggagaagaccccaccgcctagacccagcccgctagaggcaggcagtgatggctgtgaggagccgaagcagcaggtgtcttgggagcaggagttcctggtgggcagcagcccaggaggcagcgggcgggcactgtgcatggtgtgtggcgctgagatccgggcaccctcggccgacacagctcgctcgcacatcttggagcagcaccctcacaccttggacctgagcccttctgagaagagcaatatcctggaggcctggagtgaaggggtggccctcttgcaagacgtgagagctgagcagccgtccccacccaactcagactcgggccaggatgcccacccagacccagacgccaacccagacgctgccagaatgccagccgaaatcgtcgttctccttgactctgaggataacccatccctccctaaaaggagcaggcccaggggactccgccccctcgagcttcctgctgtccctgccacagagccaggaaataagaagccccgtggtcagagatggaaggaacccccaggggaagagccagtcagaaagaaaagaggcagacctatgaccaaaaacctggaccctgacccagagcccccatcgccagactcgcccacggagactttcgcagcaccagccgaggtccgacacttcactgacggcagcttccccgccggcttcgtcttgcagctcttctcccacacccagctcaggggcccagacagcaaggactcacccaaagacagggaagtggcagaaggaggccttccccgggcggagagcccctctccagctccccctccggggctccgcgggacactggatctccaggttatccgcgtgcggatggaggagcccccagcggtcagcctcctgcaagactggtccaggcacccccagggcaccaagcgtgtgggagcaggtgacacctcagactggcccacagttctgtcagaatccagcaccactgtggcagggaagccggaaaaagggaatggagtgtaaattcttgctttcctggggagggagggagggatgaggcagcgtcccccagtggcttataactcagagctgcctggctcacccacctggtggagagagtagaaacaggtgccagggcaggagggggctggggcagcatccactgttatttcggggcactggaaagtgtctgttcctggccaggcctgaggtcggcgagggtggctgaggctgttgtgcagtagggcactgggcctgtggagaacacctaccccagtccttcgctgacccccacctctgtttgtcccccatgacctcctcccaccctccccctgctccccaccattctcccttggcacagtgccttacacaagagtggtcataagggggtttgaactgagtcccactacctcgggggacacctctcctccccacttgttcaggcttctaaaccaggaggcctccattacctcttcctgtcccaaccctgcagaggcctgaagctgggcctgggcaccccattcactcccgttctcatttacatctgttttcctgttgtatatatcacctttgttgacaataaattatttttttttattaagaaaaaaaaaaaaaaaaaaaaaaaaaaaaaaaaaaaaaaaaaaaa

SEQ ID NO: 513 - DNA, 3094 bp, Human
tgaaacagagctagaaggatgccatgaaggaaatgactgctttgtaaagcgagggtaaacttctgaaatgctttgattaaaataagctatattaaagaccccaaaaccacttccctcgcagctttcctctgaatgtctttcacatgaaatgggcctgagtcactctaagactcaccttagggtgatcaaagtagcacctttgcaaaacaaagaggtagagactccctcggctggccgtgtggactttgcattcaatcagaatttggaagaaaagacttcatattcactggcaagactgcaggaccagaataaagccttggaagggcagctgccacctttacaagaaaactggtatggaagatattctacagcatccagagacatgtattttgacatcccactggaacacagagaaacaagtattattaaaaggcatccaccccaaagacttcaaaagcttgaacccattgacttgccacgagtaattacttcaggaagactcctgagccagcgagaagccaggacaatgcacaaagcaaagcaggtactagaaaagaaaatgcaaactccaatgtatacttctgagaacagacaatatttgcataagatgcaagtgctggaaatgatccgtaaaagacaagaggcccaaatggagttaaagaaaagtcttcatggagaggcaagaattaataagcaaagtccaagggaccataaagccaagaaaacccttcaaagcaccccaaggaatgatgaccatgaccttctaaccatgttgcctgatgaaatcttgaacagaggtcccggaaattcaaagaatacagaatttttgaaacatcaagcagtgaataactactgtccctggaaaattggcaaaatggaaacatggcttcatgaacaagaggcccagggacagcttctctgggacagttccagctctgactcagatgagcaggggaaagatgagaagaagccacgagcactggtgaggaccaggacagagagaatcccacttttcgatgagttttttgatcaagaataagaatactattcattaacctagaaactgagtgctttgaaagcttgttttactctcaaaatcttccaaactgatatatgaattactttgaggacagcaaatcactttggtaaaaagaaatgatatctttagagtcttatgattaacaagtccgtcacatgtgctgttaactattgctgcataactaaatgcctcaaaacacaggggctaaccaagagccattttattgtctcactttcctgtgggttgctgagttcagctaggtggttcttctgctgttcccttttgaaatctttcatgtcattgaaattggactacatttggactactaagactggagtcatccagaggccccattaggacactgacacagggggaccttgccccctatccatgtagcctcagagcatctgcatatgatctcttcagcaggacactgcagagatttctctcatatgagcccagggctcccaaaagcaattgtctcaagaggaggaaacagaagttgccagtcttcttaaaagctagtcatagaactgactttgcatcacttccaccatgttctgttggttaaagtcatagaccagcttggagttaatgcagaagaggactacacaagggcatgagtgccaaagtgtggtcctttggggttcatctttgacatttgccacctcaccatgtttttaaaaagaaaattagattacataaaacaaatagatgggctggatgtggtggctcacacctgtaatcccagcactttgggaggccgaggtgggcagatcacttgaggtcaggagttcaagaccagcctggccaacatggtgagacaccgtctctactaaaatacaaaaattagccagacatggtggcattcgtctgtaatcccagctacttgatgcgaaggctgaggcaaaagaattgcttgaacccaggagatagaggttgcaatgagccaagatcactccactgcactccagcctgggcgacagaatgagactctgtctcaaaattaaaaaacaaaaaaccaaaaacaaatagatgaaaaagtagactggagacaaataaaagtgagtttctaaaggaaattcacagtaatgctgcattaaacactaagctcacttaggtcactttctagtgagctaaccgtaacagagagcctacaggatacacgtgagataatgtcacgtgtagaagatcgttgtgaattaaagttcaaaattaagacttcttagattatgatgtagattttagagctccttaaaacataaagcgaatcttataaatgttcaattctaaagttattccacttggaaaaattagcttttgggacaatttttaagaacttttgtgtaaaatgcagctccatgtttagcataatctaaaaataatttcaagcaatccagaatcttccaagaatttattaaagctttaaaacaaagcaaaacaaaaagacccttttgtgccttatatgggaagactccaaaaacagaaaaaaatagaggaaaacaccacttcaatttgacattcaatgcattcacatcagaaactaagaagataacaagcctgagatgtcaggtgataaaaattcatgtttcttccaaggacagaaggctattagattgtcccaggccatatctattcccagttctttgtgagtagtcttcttactttttctgtggtaggtaagaagcatatttccaccaaaagaaagcatgcattgtttgactagccagctttctagaaaaaatgagatccttgagaggataaacaaatccaacctattcatggtgtcctcacttattgtggtcaatttggaaggcttaaaacacaaaaaatgggatggataactttgaacactaaaattagtggagccaaaggcacgtcttcaccattctgttatgtgacttaaaattcaatttcacgaaacccacttccacaagcttaatgaactgtgagctacatgagggcataaaccatgtcttctttgtatggtatttctgcttcctagcaggacagctggcaaagagtttatcattaaatgtttgctgaattaatgaa

SEQ ID NO: 514 - DNA, 1659 bp, Human
agtgcgcctgcgcggagctcgtggccgcgcctgctcccgccgggggctccttgctcggccgggccgcggccatgggagaggccgaggtgggcggcgggggcgccgcaggcgacaagggcccgggggaggcggccaccagcccggcggaggagacagtggtgtggagccccgaggtggaggtgtgcctcttccacgccatgctgggccacaagcccgtcggtgtgaaccgacacttccacatgatttgtattcgggacaagttcagccagaacatcgggcggcaggtcccatccaaggtcatctgggaccatctgagcaccatgtacgacatgcaggcgctgcatgagtctgagattcttccattcccgaatccagagaggaacttcgtccttccagaagagatcattcaggaggtccgagaaggaaaagtgatgatagaagaggagatgaaagaggagatgaaggaagacgtggacccccacaatggggctgacgatgttttttcatcttcagggagtttggggaaagcatcagaaaaatccagcaaagacaaagagaagaactcctcagacttggggtgcaaagaaggcgcagacaagcggaagcgcagccgggtcaccgacaaagtcctgaccgcaaacagcaacccttccagtcccagtgctgccaagcggcgccgcacgtagaccctcagccctggtggcggcagagaagcgggcgaggcactgtggtcgctgagggggttggctgggtctgagtgccaccccccaggccacagtgataccatcccagtgccatgagcccacactgcccgccctcaggctctcaggtgaacgtggccgtcagcggggaaacgtgtgtgtcagttggaccatgtgggaccctgatggacctgaaagaccaggatcggtccagctcagatattgagggctctgaagcctagttctgtcttctctggagcagctgtggcttccccgtggctgcttggtgacatggattagcgctacgtgggctgcagcatttgggatccaggctacctagaggggcatcgggccagggaaaacctcggattagcaagcaataaaaacatgacctcactcttcctcaaaggagcccctggtcttccctgtgtgactcagttctttccatctgtttgtcccgctgcaagcctctttctgcgctgactgtgacattggaacgtggccttcctgtcaccccctccgtgccacgcactgaaggccacccccacccacctgggaaactaagaactggatattttgcctcattcacttgtactgtaacaatgtatataatttggttggtatttcactatttaatttttaagaagcctattttactagtgttttatatgaacaaagtactgcagaagttaaacctgtgttgtattttttctgagatgttttgctttaagagatactttttgctcagtttttatatgccagatacagagaatttgtagcggttatttttgtatgatctagtaacttgcaaacagaccaaatggatgagaggcggggaccgtgcagctgtcggctgatgaggaggcggccgccccagtgctgatggagatgccactttcgtgtgactgcgaacattaaagcacaaaaaaatccaaaaaaaaaaaaaaaaaaaaaaaaa

SEQ ID NO: 515 - DNA, 1596 bp, Human
tgccccggtcgggcgggacttcctgtgtcgtatttccaaggactccaaagcgaggccggggactgaaggtgtgggtgtcgagccctctggcagagggttaacctgggtcaaatgcacggattctcacctcgtacagttacgctctcccgcggcacgtccgcgaggacttgaagtcctgagcgctcaagtttgtccgtaggtcgagagaaggccatggaggtgccgccaccggcaccgcggagctttctctgtagagcattgtgcctatttccccgagtctttgctgccgaagctgtgactgccgattcggaagtccttgaggagcgtcagaagcggcttccctacgtcccagagccctattacccggaatctggatgggaccgcctccgggagctgtttggcaaagatgaacagcagagaatttcaaaggaccttgctaatatctgtaagacggcagctacagcaggcatcattggctgggtgtatgggggaataccagcttttattcatgctaaacaacaatacattgagcagagccaggcagaaatttatcataaccggtttgatgctgtgcaatctgcacatcgtgctgccacacgaggcttcattcgttatggctggcgctggggttggagaactgcagtgtttgtgactatattcaacacagtgaacactagtctgaatgtataccgaaataaagatgccttaagccattttgtaattgcaggagctgtcacgggaagtctttttaggataaacgtaggcctgcgtggcctggtggctggtggcataattggagccttgctgggcactcctgtaggaggcctgctgatggcatttcagaagtactctggtgagactgttcaggaaagaaaacagaaggatcgaaaggcactccatgagctaaaactggaagagtggaaaggcagactacaagttactgagcacctccctgagaaaattgaaagtagtttacaggaagatgaacctgagaatgatgctaagaaaattgaagcactgctaaaccttcctagaaacccttcagtaatagataaacaagacaaggactgaaagtgctctgaacttgaaactcactggagagctgaagggagctgccatgtccgatgaatgccaacagacaggccactctttggtcagcctgctgacaaatttaagtgctggtacctgtggtggcagtggcttgctcttgtctttttcttttctttttaactaagaatggggctgttgtactctcactttacttatccttaaatttaaatacatacttatgtttgtattaatctatcaatatatgcatacatgaatatatccacccacctagattttaagcagtaaataaaacatttcgcaaaagattaaagttgaattttacagttcgtatattcatgtggtcctttgaaagggtattctagaaatcactggaaagaggagaggaaagaaccaggtaggcaaatggtctgtgaaacccttgggtcctggaagcagtgtgagtgtaaatgtgtagtgtttggtttcatctaaataaacaaagatgatttctttgacacttgaaataaaatacaaattcaacaaaaa

SEQ ID NO: 516 - DNA, 1084 bp, Human
cagacagcagggaacatcaccctcttcagactggagtcagtgggaacagacccaagatgttggggaggaacacttggaagacctcagctttctccttcttggttgagcagatgtgggcccctctctggagtcgttcgatgaggccagggcgatggtgttctcagcgttcctgtgcatggcaaaccagcaataacactttgcacccactctggacggtcccggtctccgtgccagggggcacccggcagtctcctattaacatccagtggagggacagcgtctatgacccccagctgaagccactcagggtctcctatgaagcggcatcctgcctgtacatctggaacactggctacctcttccaggtggaatttgacgatgccaccgaggcatcaggaattagtggtgggcccttggaaaaccactacagactgaagcaatttcacttccactggggagcagtgaacgaggggggctcagagcacacagtggacggccacgcgtaccccgcagagctgcatttagttcactggaattctgtgaaataccaaaattacaaggaagctgtcgtgggagagaatggtttggctgtgataggcgtgtttttaaagctcggggcccatcatcagacgctgcagaggctggtggacatcttgccggaaataaaacataaggacgcgcgggcggccatgcgccccttcgacccctccactctgctgcccacctgctgggattactggacctacgcgggctcgctcaccaccccgccgctgaccgagtcggtcacctggatcatccagaaggagcccgttgaagtggccccaagccagctctctgcatttcgtactctcctgttttctgcacttggtgaagaggagaagatgatggtgaacaactatcgcccacttcaacccttgatgaaccggaaggtctgggcgtccttccaggccactaatgagggcacaaggtcctagagacattaggtccacatgaatagcagaactgactttgaaggaaggaagcgttgtttcccaagtttcacaatgtgattgtacatgacttctgaaattaaaaagagagcatg

SEQ ID NO: 517 - DNA, 1485 bp, Human
gcacaaccccagcgcgagtgccagagcccagccggcgcggagcgggagcggtgcaggctgaggtctccgagcggctcgccatggctggcccgcagcagcagcccccttacctgcacctggccgagctgacggcgtcccagttcctggaaatatggaagcactttgacgcagacggaaatgggtatattgaaggtaaagagctagaaaactttttccaagagctggagaaggcaaggaaaggctctggcatgatgtcaaagagtgacaactttggagaaaagatgaaggagttcatgcagaagtatgataaaaactcagatgggaaaatcgagatggcagagctggcgcagatcctgccaaccgaagagaacttccttctgtgcttcaggcagcacgtgggctccagcgccgagtttatggaggcttggcggaagtacgacacagacaggagtggctacatcgaagccaatgagctcaagggattcctgtcagacctgctgaagaaggcgaaccggccgtacgatgagcccaagctccaggaatacacccaaaccatactacggatgtttgacttgaacggggatggcaaattgggcctctcagagatgtcccgactcctgcctgtccaggaaaacttcctgcttaaatttcagggcatgaagctgacctcagaggagtttaacgcgatcttcacattttacgacaaggatagaagcggctacattgacgagcatgagctggatgcccttttgaaggatctgtacgagaaaaacaaaaaggaaatgaatattcaacagctcaccaactacagaaagagcgtcatgtccttggcagaggcagggaagctctaccgcaaggacctggagattgtgctctgcagcgagccccccatgtaaagtggggacgggggctgcttctccacctcccccaaaccctgcttctgctgccctgatgcgtctacccagactcagagaccgtgagcgccccgcccccacccctacagcctgcacacacctgcctgcagagcaggaaatgagagatagaggatgggcagctggggggctgtcctgagccccctgcacccacccctgcccaggcagtctttgctcagtggatcacacacatggaaggtgatgggggcatgggtggagggtccctaattctcttcgctgtgatgcatgagctccctcgctgtatgatttaggcttctatgtccaacagagtggactcttccctctcgctcccctctgccggtcccccatgccaccacccaccccaaacttccaggttccatccaccaccttgccaatggtgtagctgtcctctcagaactcctgtgtgtggaaggcacccgccctttccttgccttctttactcggcgtgctccttttctctttgggtttcttgtttaccaaagaagagtttacagacaataaaatggaaaggtcctgctgtggaaacttacccaaaaaaaaaaaaaaaaaa

SEQ ID NO: 518 - DNA, 1314 bp, Human
gactcaccgggggcggctcctggccgcgcacctccagggggcggggggcggctgagacagcgcccagggcctcggagcaaggcgttggcagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccatttgcccttgaactgctgatatctgatgactgctttgtgctggacaacgggctctgtggcaagatctatatctggaaggggcgaaaagcgaatgagaaggagcggcaggcagccctgcaggtggccgagggcttcatctcgcgcatgcagtacgccccgaacactcaggtggagattctgcctcagggccatgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttcccagctcttttcctgcaccaccaaaaaaaaaaaaaaaaaa

SEQ ID NO: 519 - DNA, 1453 bp, Human
actctgggcgaggccgcccctatcccagccgcaccggtccttcccggcacacgcgaggctcccatggctctggcggtggccccgtgggggcgacagtgggaagaggcccgcgccctgggccgggcagtcaggatgctgcagcgcctagaagagcaatgcgtcgacccccggctgtccgtgagtcccccttcgctgcgggacctgctgccccgcacagcgcagctgcttcgagaggtggcccattctcggcgggcggccggcggaggcggccccgggggtcccggcggctctggggactttctactcatctacctggccaatctggaggccaagagcaggcaggtggccgcgctgctgcctccccggggccgaaggagtgccaacgacgagctcttccgggcgggctccagactcaggcgacagctggccaagctggccatcatcttcagccacatgcacgcagagctgcacgcactcttccccgggggaaagtactgtggacacatgtaccagctcaccaaggcccccgcccacaccttctggagggaaagttgcggagcccggtgtgtgctgccctgggctgagtttgagtccctcctgggcacctgccaccctgtggaaccaggctgcacagccctggccttgcgcaccaccattgacctcacctgcagcgggcacgtgtccatcttcgagttcgacgtcttcaccaggctctttcagccatggccaacactcctcaagaactggcagctcctggcagtcaaccacccaggctacatggccttcctcacctatgatgaggtccaagagcgtctgcaggcctgcagggacaagccaggcagctacctctacccagatggaaagacccacaacccagacctgactgagctcggccaggcagaaccccagcagcgcatccacgtgtcagaggagcagctgcagctctactgggccatggactccacatttgagctctgcaagatctgtgctgagagcaacaaggatgtgaagattgagccgtgcgggcacctgctctgcagctgctgcctggctgcctggcagcactcggacagccagacctgccccttctgccgctgcgagatcaagggctgggaggccgtgagtatctaccagttccacggtcaggctactgctgaggactcagggaacagcagtgaccaggaaggcagggagttggagctggggcaggtgcccctttcggctcctccattgcccccacggccagatctgccccccaggaagcccagaaatgcccagccgaaagtgagactcctaaaggggaactcccctccagctgcgctgggaccccaggaccctgccccggcctgaaggccagggcacccagatgtgctgctcaagggagccccaagggctggaagggggttgtgaaaccgaaataaactgccaagcctggtctgtcctccagggtgca

SEQ ID NO: 520 - DNA, 3644 bp, Human
acagtcagcaccgccccagccaggcgcctgcgcgcccacgcactacctgccgggagttgtagtttcggctcggcagacccggcgagcccagtggccgcgctccggtgcggcggcgcccgaggcccgaggcggaagtgggacggccaagcagggaagcgagggctcgggatcgacggccgcggggcgccgacgaggagtgcaggactcaggaagggcgagtgcgcggcgacagagcccggggaaggaggcagggcaaggccgggcttgggggcaggtggtccgggcatccagccttgaagatgcacaagaggaaaggacccccgggacccccgggcagaggcgccgcggccgcccgccagctgggcctgctggttgacctctccccagatggcctgatgatccctgaggacggggctaacgatgaagaactggaggctgagttcttggctttggtcgggggccagcccccagccctggagaagctcaaaggcaaaggtcccttgccgatggaggccattgagaagatggccagcctgtgcatgagagacccggatgaggatgaggaggaggggacggatgaggacgacttggaggctgatgatgacctgctggcggagctaaatgaggtccttggagaggagcagaaggcttcagagaccccacctcctgtggcccagccgaagcctgaggcccctcatccggggctggagaccaccttgcaggagaggctggcgctctatcagacagcaattgaaagcgccagacaagctggagacagcgccaagatgcggcgctacgatcgggggcttaaaacactggaaaacctgctcgcctccatccgtaagggcaatgccattgacgaagcggacatcccgccgccagtggccataggaaaaggcccggcgtccacgcctacctacagccctgcacccacccagccggcccctagaatcgcgtcagccccagagcccagggtcaccctggagggaccttctgccaccgccccagcctcatctccaggcttggctaagccccagatgcccccaggtccctgcagccctggccctctggcccagttgcagagccgccagcgcgactacaagctggctgccctccacgccaagcagcagggagataccactgctgccgctagacacttccgcgtggctaagagctttgatgctgtcttggaggccctgagccggggtgagcccgtggacctctcctgcctgccccctccacccgaccagctgcccccagacccaccgtcaccaccgtcgcagcctccgacccccgctacggcgccctccacaacagaggtgcccccacccccgaggaccctgctggaggcgctggagcagcggatggagcggtaccaggtggccgcagcccaggccaagagcaagggggaccagcggaaagctcgaatgcacgagcgcatcgtcaagcaataccaagatgccatccgagcccacaaggctggccgagccgtggatgtcgctgaattgcccgtgcccccaggcttccccccaatccagggcctggaggccaccaagcccacccagcagagtctggtgggtgtcctggagactgccatgaagctggccaaccaggatgaaggcccagaggatgaagaggatgaggtgcctaagaagcagaacagccctgtggcccccacagcccagcccaaagccccaccctcaagaactccccagtcgggatcagccccaacagccaaagcgccccccaaagccacatccaccagagcccagcagcagctggccttcctagagggccgcaagaagcagctcctgcaggccgcactgcgagccaagcagaaaaacgacgtggagggtgccaagatgcacctgcgccaagccaagggactggagcctatgctggaggcctcgcgcaatgggctgcctgtggacatcaccaaggtgccgcctgcccctgtcaacaaggacgactttgccctggtccagcggcctggcccgggtctgtctcaggaggccgcccggcgctatggtgaactcaccaagctcatacggcagcagcacgagatgtgcctgaaccactcaaaccaattcacccagctgggcaacatcactgaaaccaccaagtttgaaaagttggcggaggactgtaagcggagcatggacattctgaagcaagccttcgtccggggtctccccacgcccaccgcccgctttgagcaaaggaccttcagcgtcatcaagatcttccctgacctcagcagcaacgacatgctcctcttcatcgtgaagggcatcaacttgcccacacccccaggactgtcccctggcgatctggatgtctttgttcggtttgacttcccctatcccaacgtggaagaagctcagaaagacaagaccagtgtgatcaagaacacagactcccctgagttcaaggagcagttcaaactctgcatcaaccgcagccaccgtggcttccgaagggccatccagaccaagggcatcaagttcgaagtggttcacaagggggggctgttcaagactgaccgggtgctggggacagcccagctgaagctggatgcactggagatagcatgtgaggtccgggagatccttgaggtcctggatggtcgccggcccacaggggggcgactggaggtaatggtccggattcgggagccactgacagcccagcagttggagacgacgacagagaggtggctggtcattgaccctgtgccggcagctgtgcccacacaggttgctgggcccaaagggaaggcccctcctgtgcctgcccctgcaagggagtcagggaacagatcagcccggcccctgcatagcctcagtgtgctggcgtttgaccaagagcgtctggagcggaagatcctggccctcaggcaggcgcggcggccggtgcccccagaagtggcccagcagtaccaggacatcatgcaacgcagccagtggcagagggcacagctggagcaggggggtgtgggcatccgacgggaatacgcagcccagctggagcggcagctgcagttctacacggaggctgcccggcgcctgggcaacgatggcagcagggatgctgcaaaggaggcgctctataggcggaatctggtagagagtgagctgcagcggctccgcaggtgaggagcccatggggcgggcagcccccagaaagcgggcagcaggccccgataccgggaagagccgacacagccacgaaccagacaagcagacaatcagcggacaatcggttctggactcacccctcatccgggcccccagccccgccagagcctccgtggctgcgggtgttgggaaccatgcctgccagccagtatgtgcccctcacccaggcctggctgggccctggagagtcctgtttgcacagcccaggggtgtccggcctctggcccgccccggagcagggagggtggctggggccaagccccgagggcccctgcaagcactttacttcctgttcctccccagccttaaccccaaagccctcctgcaccccaaagaagccactgaggctggccgagccacactgtctccccaggggcgtcgacctggcccagctgggtccccagggccagcacatggaataaaatagccagggccacactcagaaaa

SEQ ID NO: 521 - DNA, 2109 bp, Human
ggaagtggcttcgctagggagcctcccggcgtggagatggcgggagctggtcgcggagcagcggtgtccagggtgcaggcgggtcctgggagtccccggcgagcgcgggggcggcagcaagtgcagccgctggggaagcagcgcccagccccgtggcccgggcttcgcagcaaagagaagaagaaagtgaactgcaagcccaagaaccaggacgaacaggagattcctttccggctccgggagattatgaggagccgccaagagatgaaaaacccgatcagtaacaagaagaggaagaaagcagcccaggtgaccttcagaaagacattggagaaggaagcaaagggagaggagcccgacatcgcagtccccaagttcaaacagaggaagggggagtccgacggggcctatatccaccgcatgcagcaagaggcccagcatgtgctgttcctcagcaagaaccaggccatccggcagccagaggtgcaggcagctcccaaggagaagtctgagcagaaaaaagcaaaaaaagcgttccagaagcggcgactagataaagtccgacggaaaaaggaggaaaaggcggcagacaggctggagcaggagttgctccgagacacggtgaagtttggtgaggttgtcctgcagcccccagagctgactgccaggccccagaggagcgtaagcaaggaccagcctggcaggagatcgcagatgctgcggatgcttctgagccccggtggtgtgtcccagcctctgaccgcctccctggcccgccagcggattgtggaggaggagagagagcgggccgtgcaggcctacagagcgttgaagcagcggcagcagcagctgcacggggagcgaccccacctcacttcccggaagaagccagagccgcagctgtgatggagagacacccggggcctggccacgctctggggcaactggcaccaggagctgctacacctgggtaggagagaggcaggccatgccagcagtgtggggtgaggcctccagctacttgttcacacgttgggcactagtgggtccacatcttgcagggggtgagtgcccgatggactagggccaaggcctggttgacagacggcccgtggggcccggtgtcactcacagctccatctctttgttttgaacgtccattctgagtctcagcccaggtggaccttaggaagggctggatccctgtccctgaacaccaaataccgagacagctgatgaggctggctcagtgtgtgacggaggcccccgggagtcagcagagccgagcgtacagtgcacatcaggcagagcaggccacgggcagggacgacgcatcgggacagggctctgcaggggaccgtgactacaggccagctgtgagtggtcccctacagaggctgcccacccaaggtttggttggggtgaaacatgatgacaacacatacacttaagaaggtgggaaccgggggccgggcgcggtggctcacacctgtaatgccagcactttgggcagctgaggcgagtggatcacctgaggtcaggagttcgaaccagcctggccaacatggtgaaactgcatctctactaaaaatacacgaagaaaaaaaaaacagtgggaacagagttgtcacctacctaacagggctctgagagagccgggaggcccaaagtggctggaagaaggtaaaggaaaaatcctgtcttgggctcaaggtcacagagtggggcccagggggagttcctgctgagggcagggccttgccaggcttcagtctccagtgccaaaggaggaaatgcccaggctgtcagcatttccagatgagagcagaagggagaagcttaaacccaagtcacacatccagcaatggagtccgacagcccagcaccatctgggaactgagaagcacctctgcccggcccccacaccgtgtggaaagtgaggagcacctctgcctggccgccaccccgtctggcaagtgaggagcgcctctgcccggccgctgtgcaaccttccaagtgtgaagtgacagccttgtgtgtgatgttttctgccttccccaagtttgcactttcgacattaaagtttactttttagttaaaagttttaaa

SEQ ID NO: 522 - DNA, 3562 bp, Human
ggatgttgacagcgtcgcctagcaacgggaaatggcggaaccgggcggcgcggcgggccggtcccatccggaagatggatcggcttctgagggagagaaggaagggaataatgaaagccacatggtgtcaccaccagagaaggatgatggccagaaaggtgaagaagctgtcggtagcacagagcatcctgaggaagtcacaacccaagcggaagctgcaattgaagagggggaggtggagacagaaggggaagcagcagtggaaggggaagaggaggctgtgtcctatggagatgctgaaagcgaagaggaatattactatacagaaacttcatccccggaagggcaaatcagtgctgcagatacgacttacccgtatttcagtcctcctcaggaactgcctggagaggaggcatacgatagtgttagcggggaggctggtctccaaggcttccagcaagaggccaccggtccaccagaatccagagaaaggagggtcacctccccagagccatcccacggagtcttaggcccgtcggagcaaatgggccaggtcacctctgggccagcagtgggcagattgacaggatccacagaggagccccaggggcaggtgctcccaatgggcgtccagcaccgcttccggctgagccacgggagcgacatcgagtcctcagacctggaggagttcgtctcgcaggagccagtgatccccccaggggtgcccgatgcccaccccagggaaggagacctgccagtgttccaggaccagatccagcagcccagcaccgaggagggggccatggcagagagagtggagtccgaggggagtgacgaggaagcagaagacgaagggtcccagctggtggttttggacccagaccaccccctgatggtaagattccaggctgccctgaagaactacctgaaccgacagatcgaaaagttgaagctggacctccaagagctggttgtggctaccaagcagagccgagcccagcggcaggagctgggggtgaatctctatgaggtgcagcagcacctggtacacctgcagaagctgctggagaagagtcacgaccgccacgcaatggcctcgagcgagcgcaggcagaaggaggaggagctgcaggccgcccgcgctctctacaccaagacctgcgcagccgccaacgaggagcgcaaaaagttggcggctctgcagactgagatggagaacttggccctgcatctcttctacatgcagaacatcgaccaggacatgcgtgacgacatccgcgtgatgacacaagtggtaaagaaggccgagacggagaggatccgggcagaaatcgagaagaaaaagcaggacctgtatgtggaccagctcaccactcgagcccagcaactggaagaagacattgccctgtttgaggctcagtacttggcccaagctgaggacacccggattttaaggaaagcagtgagtgaggcctgcaccgagatcgacgccatcagcgtggagaagaggcgcatcatgcagcaatgggccagcagcctggtgggcatgaagcaccgcgacgaggcgcacagggcggtgctggaggcgctcagaggatgccagcatcaagccaaatccaccgacggcgagattgaggcctataagaaatccatcatgaaggaggaagaaaagaacgagaagctggcgagcatcctgaaccggacagagacggaagccacactgctgcagaagctcaccacccagtgcctgaccaagcaggtggccctgcagagccagttcaatacctacaggctcaccctgcaggacacagaggatgccctcagccaggaccagctggaacaaatgatactcacggaggagttgcaggccatccgccaagccatccagggcgagctggagctcaggaggaagacggatgctgccatccgggagaagctgcaggagcacatgacctccaacaagaccaccaaatacttcaaccagctcatcctgaggctgcagaaggagaagaccaacatgatgacacatctttccaaaatcaacggtgacattgcccagaccaccctggacatcacacacaccagcagcaggctggacgcacaccagaagaccctggtggagctggaccaggacgtgaagaaagtcaacgagctcatcaccaacagccagagcgagatctcccggcgcacgatcctgatcgagaggaagcaagggctcatcaacttcctcaacaagcagctggagcggatggtctccgagctggggggggaagaagtggggcccctggagcttgaaatcaaaaggctgagcaagctgatcgacgagcacgatggcaaggcggtccaggcccaggtgacctggctgcgcctgcagcaggagatggtcaaggtgacacaggagcaggaggagcagctggcctccctggacgcatccaagaaggagctccacatcatggagcagaagaaactacgagtagaaagcaagattgagcaggagaagaaggagcagaaggagatcgagcaccacatgaaggacctggacaacgacctgaagaagctcaacatgttgatgaataaaaaccggtgcagctcggaggagctggagcagaacaaccgggtgacagagaatgagttcgtgcgctcgctgaaggcctctgagagggagaccatcaagatgcaggacaagctgaaccagctcagcgaggagaaggcgaccctcctgaatcaactggtggaagcagaacaccagattatgctttgggagaaaaaaatccaactggcaaaagagatgcgttcctcagtggattccgagatcggccagacggagatccgggccatgaagggcgagatccacaggatgaagaaatattgcagaacaacacaggacgcacacaggcacgtgcacgaacaacacgggacgcacgcaggcacgtgcacgaagaacacgggacgcgcgcaggcacgtgcacgaacaacacgggacgcgcgcgggcacgtgcacgaacaacacgggacgcgcgcaggcacgtgcacgaacaacacgggacgcgcgcaggcacgtgcacgaacaagggacgcgcgcaggcacgtgcacgaacacaggacacacacagcacgtgcatgaacaacacaggacacacacagcacgtgcatgaacaacacaggacacacacaagcacgtgcatgaacaacacaggacacacacaagcacgtgcatgtcatctcacaaaacgctgttttattcctactccatgtaatcacagcacgctggtatttttaaatgccggttgtaaccctcaaactttgtgaccctctaacgtatcccactgtgagacagtctcacaccacagaagggctcagagagcacccccatctcatccttcacagccgcgttgtctctccatggtcacaattagatttcattgcctttaaaaggctggtaattaaattgcaagtggtcatcaagctaaaggttcagggccttaaggataacagtaagagcagttcataaaataaatgggcctcactttcaccatgccatgctaaaaaaaaaaaaaaaaaa

SEQ ID NO: 523 - DNA, 2088 bp, Human
actgcggtaggcgccctaggggcttgcaggaccctgaccccaagatggcggcgcccagcgaagtggccgcgatagcccctggcgaaggcgatggcggaggcggcggctttggctcctggctggacggacggttggaggcactgggagtggaccgagccgtttatggagcctacatcttgggtatcctgcaggaggaggaggaagaagagaagctggacgctctgcaggggatcctctctgctttcctggaagaagattccctccttaatatctgcaaggagattgtggaacgatggtcagaaactcagaatgttgtcaccaaagtgaaaaaagaagatgaagtacaggccattgccaccctaattgagaagcaggcacaaatcgtagtaaagccaaggatggtgtcagaagaggagaagcagagaaaagctgccctcctggcccagtatgctgatgtgacagatgaagaggattctgttccgaaacaccaatgtggaagatgtccttaatgcccgaaaactggagcgagactcacttcgggatgaatcccaaaggaagaaggaacaggacaagctgcagagggagagagacaaactagccaagcaggagcgcaaggaaaaggaaaaaaaaaggacacagagaggggagcgaaagcgataaccttggcctactctattctttccccccatgaacttatcaaagggagaactggttgtgtatttaagagaaatgagagtgcattgcaaagtagtttcccaaggcatttcccctattgtttacatggtcaaaaggaaaatcaaaatcacttctaattacaaaatgtgctgttttggtggggtgggcaatcagattattatagttgatgactgtaccaaagatctggaatgggggccacctttatattttaatactcaagtcctgtgctccttttggccactttaaaaagtcttccctcaccttggataaataggattcagaaagctaacagttttcattctgaaggagcagaaacataatcaatccctccctgagataaaatgtgggcatgcacattgctttggagtcagtattcagctgtaagtgtagtattgttttatggctgaaatagaaagctaatgaagaggcctacctggatccagattttatgttaacatggcagcaaaactaggaaaatgggaagaaattacttgcggggtgttctagatctgattttttttttttttttgaaagtttcagcctgtgggaggaaaagaggtatcttttaaaatagagatagttacatattttcctcatctaggctgtgtcactattgggtgcaaggatatcattgttggctagattcattttgtataatcatgtatcctcttgtgtgctggtagagattttaatcctgatttttccataaaacatgagtattaagaaataattcctggtttggagaaactggagaaatcacccttttaaggaagaaacactggaaatttctgctaacaccaagatatttaagagtgtacatagtaggtgctcaacaaatttattgaatgaatgagtgaatggaaaaactgggagagtcaaaagtgagcagaagctctccatttctacttctgtcacaaaccacattaaattgtaaataaggcccttctccacttgacttcaggcagcagattgtctagaagcctaaggacagcaatttctctgacaagacaaagtagatattttataccaggggttggcaaactactgcccacgggccgaatttggcccagtctgtttttgtatggtgcaaactaaaaatgatttttacatttttaaagagttataaaagaaaaaaatatgtggtctgtgaaatctaaaatatttactacctggcctgttggaggaaaggtttgccaatctctgttttataccattaactatgagattaacaaaaacttttacctttgtgcagaaggttaaaaaaaaaaaaacatggttaaggaaaaggagacatgttacctcttcatacactcctataactgtggcattgcaaaaaataaaaataaccacctttaaaaaaataaatcttatttaaattgctgtaaaaaaaaa

SEQ ID NO: 524 - DNA, 2650 bp, Human
atcattaggcgtcaacacaggaagtgaggatacttctggcgagcgccggttgctgtttcttctcaggctcagggaccggccgcggccccgtagggtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcactgcatggagatcacaataaggaactccccgtatagaagagaagactcaatggaagacagaggagaagaagatgattctttggccatcaaaccaccccagcaaatgtctcggaaagaaaaagttcatcacagaaaagatgaaaagagaaaagaaaaatgtaggcatcatagccattcagcagaaggggggaagcatgctagagtgaaagaaagagagcacgaacgtcggaaacgacatcgagaagaacaggataaagctcgccgggaatgggaaagacagaagagaagggaaatggcaagggagcattccaggagagaaagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcggaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgttgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtccctgagggagatcaacaccatcctcaaggcccagcatcccaacattgtcaccgttagagagattgtggtgggcagcaacatggacaagatctacatcgtgatgaactacgtggagcacgacctcaagagcctgatggagaccatgaaacagcccttcctgccaggggaggtgaagaccctgatgatccagctgctgcggggggtgaaacacctgcacgacaactggatcctgcaccgtgacctcaagacgtccaacctgctgctgagccacgccggcatcctcaaggtgggtgattttgggctggcgcgggagtacggatcccctctgaaggcctacaccccggtcgtggtgacccagtggtaccgcgccccagagctgctgcttggtgccaaggaatactccacggccgtggacatgtggtcagtgggctgcatcttcggggagctgctgactcagaagcctctgttccccgggaattcggaaatcgatcagatcaacaaagtgttcaaggagctggggacccccagtgagaaaatctggcccggctacagtgagctcccagtagtcaaaaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatggggagaactcagccgggaccacaggcgtggctactgcggctggagctgcgatgagactcggaactcctcgtcttactttgtgctccatgttttgtttttgtattttggtttgtaaatttgtagaattaaatcattttccttgttgtggaggaaaaaaaaaaaaaaaaaaaaaaaaa

SEQ ID NO: 525 - DNA, 2947 bp, Human
cctgtttgtccgccactgtttgaaaacagttggcgccgccgccgccggggcctcatttccaggtcagcccccggcctgacgcggcgttgcgtcccccgggagctgcgctaggcgaacggctgcggcgctttgtgctccagtcgctcctaacgctccctggcccggccggggccgcgcagttagggcatctgaggcggggagaagcggcggggagacgccggctgccagcatgtcgctgcctccggagaaagcctccgagctgaagcagctcatccaccagcagctgagcaagatggatgtccatggtagaataagagaaatccttgctgagactatacgggaagaattggcacctgatcaacagcatttatcaacagaagatttgatcaaagcccttagacgtcgaggaatcattgacgatgtgatgaaagaacttaattttgttactgacagtgttgagcaagaactcccttcctctccaaaacaacctatttgttttgatagacaatcgacattaaaaaaaactaatattgatccaacacggaggtatctttaccttcaggttttgggtggaaaagctttcttggaacatctgcaagaacctgagcctttacctggacaagtttgttcaacgtttactttatgtttacattatcgaaaccaacgttttcgttctaaacctgttccatgtgcctgtgaaccagattttcatgatggctttttacttgaagtacacagagaaagcttgggtgatggaactagaatggctgattcaacaacaatgttatcaataagtgatccaattcatatggtgctaatcaaaacagacatatttggtgagacgactttagtagcatcatattttctggaatggcgatcggttttgggctcagaaaatggagtgaccagtctgactgtggaacttatgggtgtaggcacagaatcaaaagtttctgtgggaattttaaatataaaacttgaaatgtatccaccactcaatcaaacgttatctcaagaagtagtgaacacacagcttgctttggaacgtcagaaaactgcagagaaagagcgattatttcttgtatatgctaagcagtggtggagagaatatttgcaaattcgaccctcacacaactcacgactggttaagatttttgcacaggatgaaaatgggataaatagaccagtctgttcctatgttaaaccacttcgagctggacggcttcttgatactccaaggcaagcagcaagatttgttaatgtccttggttatgaacgagcccctgttattggaggaggaggtaaacaggagcagtggtgcactctgctggcctttctctgtagaaacaagggtgactgtgaagatcacgctaaccttctgtgcagccttcttcttggatatggattagaagcctttgtttgtgttgggaccaaggcaaaaggagtacctcatgcatgggttatgacttgtggaactgatggggccatcactttttgggagagtttaacaggacacaggtacatccataaacctaccaatcctgatgaacctccagttgctgaacagcccaaaccactgtacccatatcgaacaattggttgtgttttcaaccatcagatgttcctgggaaattgtcaaccctctgatgcagtagaaacctgtgtatttgatttgaacgatgaatccaaatggaaacccatgagtgaggaagcaattaaatctgtgtgtgctcctggagctacaacatcccttcctccctttccacctctgtgtgcatccacaattgacgcgtcagtaacaagtaatgaaattgaaatgcagctgaggctcctggtgtcagaacacaggaaggatcttggcctcactactgtttgggaagaccagctctcctaccttttatcaccagctttggcttcttatgaatttgagcgtacaacaagtatatcagcaggcaatgaagaatttcaagatgccataagaagggctgtacctgatggtcacacatttaaagggttcccaatacattttgtgtatagaaatgcaagacgtgcatttgccacatgtcttcgatctcctttctgtgaagaaataatctgttgccgtggagaccaagtgcgactggcagttcgtgtccgagtatttacttaccctgaatctgcatgtgctgtttggatcatgtttgcttgtaaatatcgctcggtattatagggccaatatttatataagatttatacctgtgtttaattggaattttacacattgtacattacttagctatttagaggtttgttattttaaaatcacaatctggcttgaatggcatacttcaattttgtatatacttgactggtaatgtttaaaaaaaatcatgcattcctttaaaaattaaggctgaaaaacttgtataaatctccctggaatttagtataaattaagtgtatattctattttaataaatgctactttgtttacagttatcagtagtttaaatattaatataaaatgcattcagttttctttacacaaacaggtaatcaaagagatgtttgtctaagggtttgagccctagacaaatcagtatgatcattacttttcacaggttaatggaattattttatacagattaggagaaattaacctcatgacagatttatttattgcattggtgaaaataaatgttaatgaattaccacttttgtggtttattcgtggtccttgggatatttgagactgtccagaaatttatggttggaccttgaagcaagagtaggaaaaaactaataccagaaaagcataaatattaataacctcatatgaaagtacatgaatcatttagaaatatttatcactgtgatttgttgtaaaaatgaattgggtattttagaaaaactttattatacctctttgttatgatactgataaattgtgatcttgcagtcgatcact

SEQ ID NO: 526 - DNA, 4964 bp, Human
gtaaaaatttttattaaagtaccagtaaaactaaaagtgcctacttttagttttcactgtattttcttcaactcaggccctccctctgttgttacctgccatctgacacggaattttgtgtaattttccttccaagtaaagaagggaagtttagccccagcctctaactggttcccaaagtttttgtctctgaagccgcagtcacttcctggagcgtctctggctgggtgttgcagtgctggctgggagggtggggcaacaatttacaattctgaacacgtgctttctgggcaggtcgcccctcagtctccactagagacaggactgaccagttgctcttccttccaagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggctctttggtggacaagagggggaacatcctgatccccggcattaacgaggccgtggccgccgtcacggaagaggagcacaagctgtacgacgacatcgactttgacatagaggagtttgccaaggatgtgggggcgcagatcctcctgcacagccacaagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggtcacaagctacctaactaagaagtttgctgaactacgcagccccaatgagttcaaggtgtacatgggccacggtgggaagccctgggtctccgacttcagtcaccctcattacctggctgggagaagagccatgaagacagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggccgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagagttggaggctgcgatgagccatgaatgccccactgcactccagcctgggcgacagaacgagaccccatctcaaaaaaaataagttctggttgtcattgaattgggataaacagagagcttgatgctttctgccttctgtctcaggtgatgcattgcacatttgggatatttggaaaggaaatgaggaaagaaattagggcctcctctgatctctcgctatctgcgggtcctgtccttttctcaagaccttcaccattactggcattttcctgtcttctctttagtatgatccctcaaaacctcactaactggaaggatgattttgtctcagtttgtactcctaaataaaaagtaaacatgacacctctaaaagaatcgctccatctcagttgctcgtcgcgtgcacaccatgcttattgagtggtgtctggttggtggtgtcagctcagggcaggggacagcaggcaggacccggaaaacagaacccaggtcttcccaggcgagcactccctccctcgtccacacaagtggaggctcactcgtggccccctgcatgttccgagaagtgtccctgtctctgctccttaacggctgtggggccacaggaagtccagctggcttaaacaaagaattgattggcccacttgacataaaagaacagagtaaactcaatgaaaggaaaaggctccttgaagtggttggttccagggctgggcagggaagatgcaagatgagtctggaccctctcacatcggaacgtaaggatgcgctcctgagggcgtggggctgcgtccaaggacacaggagccagcctggaagagtttgcaggggcccaggggagcaattggagtgagaaaatagcagtagtgttggatttttaccatggaataaacaacaatccatgagtccatactaatataaataaagtgacaaagtgggtgagaaggaccagtgcccctggatgaagaatctctgctcatgtgggaggaaggtgggagatcaaagctggagcacttgctgctgcaggtgagacccctgacacactctcaaattggtaggcaaaggtttaaagaacgggatatttgcttagcttaaaagcacctcccaaggggaaaacagtaacttcacagtggagagacctggcaggcaccaccctcagatcaaaatgaacctcagcagtaatgacacgtccacatcagcacccccaacaccactccctgaggaggacatgccagttctgggaacatcacactcatcgtgacaaaacatcagacaaacccaaacggatgaaatgtgaggaaaatctgtagttggttttacgtggatgttaatctcttagttttgatcattgtgctgtagctgcataagaggttagctgggtgaagtgtatctggggaccctctatggcttttgcatcttttctctaagtctcctgtcatttcaaagtaaaaacaaaaaaagaagacaagggtagcggcttcaggtacagctggacccagcactcagtgctatctgggcttgtggctccaactcaactcctccatcagaactgtgagaaatgcattctttcagcttctaatcctgcaaaaagaactgcatggtcttcccccagaaatcctaagagtagctgctggtgtctcatgcatgcgagctgcatatgggcccccgttagtcaggaacccatgctgagaggtgctatgctttgaatgtttggctcctcccaaactcgtgttgaaacttaatagccattgtaacagtattaagaggcagggccttcaagagctggtcaggccatgagggccctgtcctcctgactgagtgaatgctgttattgtaggagtgggcttgtttggcctcctcttgctctctctacccctctctgagcccttgtgttgtgggatgacacagccagaaggcccttgccaggttccggtccctccaccttggacctcccagcctcccgaacgttgagccaatacatctctgctcattgtaaattacctagtcttgggcattgtgttacagcagcaaaaagcagcctacggcagtcaccgtgctaacacctgcagcagcctgcggcggtcaccgtgctaacacgtgcagcagcctgtgtggctcaggccagtcagcttcccctggaagcaagtgtgaggtcgtcgcctctggaagtgctagcggagggtgatctcccggaggaaatcagagtggtgttctactagaaggccgatgactcctgggtaaagtgccaatgctcacctccatctctgcaagctcagtccctcgtggaatttccaggagcacaagggcaatctcgacagctccacgttcccagtgcccgacccaagcctggcccatgatcagataaatgcctaagtggggtggcatggacatttgcacacgtccagactgctttatgttagaagctgagctggcatgccactagctggttttgatgtaaacaacaattttgtaaaaccctggactgaatgggtctgactaacggctggttctgtgaacttgagcctcagcgtcctgtgtcagaagagcacaaaccactttcccagagaggttatgaagacagaaatgaccctgtgacccctttgcaaagtatgaagaacggttcccactcatgcatggagctggatcttctcaagtgggaaacaggcgtggtaaataaatactgttgtttcagctggtgtaaaaaaaaaaaaaaaaaa

SEQ ID NO: 527 - DNA, 4137 bp, Human
ggatacagaagtgatgtgagtgtctgcgagcgtggtctcgcgggcgggtgacgtcatcgaggcgagagaggcggagccgtggacagtgggcgggaggctgccaacggttttgagcgtagggggaggcgtgagagggggatctcaggggaggaggtcaatcgcttgccccccactttggcaaattggggactgaggactggaagggtggagagtaggcggaaccaggtggtcgtcggggcagaggatctcgggctaggcttgagggcggcgtgcttcttagggacgacttagggcgtgactgagggttcacaaggtttcttttggggtggtcgggagggagagattctagggaacaaggaagctcgctatggctttcttgccaggaggggtcgaagggaaagtacaagggagctgaccctgggtagaacgggtgaagggatgggggagcgtgaggttccgccctctcttgagactggaaccaattgagggactagtagggcagggggacagaaattgggctcctagtggatttgggtccgtttccgttgggacgttttgggtgtgagaacttaagagctcagttgaccggggatagcctgtgccggagttgatctgcagcttccagcactcgtagtcgggaagaggagcttcagcagcgctgttgtcccacagtaggtcttctgtccgcacccgctctgcgctgcaccctcttaacgctgttcccaggagctggggaaagggatgcttttgcccactcccatggcccctggaactggtggaaacctttcctctaaccagaaagcctcgatatccttaattcaccaaggatccttggcgtggagtcttcctcccttctcccaagtctttctccgtgaacttttcctcctggactttgctaaagcagaacctcccagctctttgctgtctccggttgtctcttccctgtattcatggcaacatcagctgacagccccagttcacccctcggggcggaggatctcctgagtgattcatcagaaccccctgggctcaaccaagtgtcgtctgaagtgacctcccagctctatgcttctttgcgcctcagccggcaggcggaggccacggcccgagcccagctgtatttaccctccacctccccgcctcatgaagggttagacggcttcgcccaagaattgagtcgaagcttgtcagtcggattggaaaagaacttgaagaaaaaggatggttctaagcatatctttgagatggaaagtgttcggggtcagctccagaccatgctccaaacctcacgtgatacagcctatcgggatcctctcattcctggcgctggctcagagagacgggaagaggactcctttgacagtgatagcacagccaccttgctcaacacccggcccctgcaagacttgtctccatctagctcagcccaagccctggaggagctgtttccccgctacaccagccttcggccagggcctccactcaatcccccagattttcaggggctgagagatgcattggattcagagcatacccgccgcaagcattgtgagcgccatattcagagcctgcagacccgagtgttagagctacagcaacaattagccgtggctgtggctgccgaccgcaagaaagataccatgattgaacaactggacaagaccctggcccgtgtggtggagggctggaaccggcatgaggctgagcggacagaggttctcaggggacttcaagaggaacaccaggcagcagagctcaccagaagcaagcagcaggagacagtaacccgcctggaacaaagcctttctgaggccatggaggccctgaatcgtgagcaggaaagtgccagactgcagcaacgggaaagagagacactggaggaggaaaggcaagctctgactctgaggttggaggcagaacagcagcggtgctgtgtcctgcaggaagagcgggatgcagctcgggctgggcaactgagtgagcatcgagagttggagactcttcgggctgccctagaagaagaacggcagacctgggcccagcaagagcaccagcttaaggaacactaccaggcgctgcaggaggagagccaggctcagctggaaagggagaaggagaagagccagagggaagcccaggccgcctgggagacccagcaccagttggcattggtgcagtctgaggtgcggcggctggaaggagagctggatacagctcggagagagagagatgccctgcagctggaaatgagcttggtgcaggcccggtatgaaagccagcggatccagctggagtcggagctggctgtgcagctggagcagcgggtgacagagcggctggcgcaggctcaggagagcagcctacggcaagcagcctccctcagggaacatcacaggaagcagctgcaggacctgagtggacagcaccagcaggagctggccagtcagctagctcagttcaaggtggaaatggcagaacgagaggaacggcaacagcaggtggctgaggactacgagctcagactggcccgggagcaagcgcgagtgtgcgaactgcagagtgggaaccagcagctggaggagcagcgggtggagctggtggaaagactgcaggccatgctgcaggcccactgggatgaggccaaccagctgctcagcaccactctcccgccgcccaaccctccagctcctcctgctggaccctccagccccgggcctcaggagcccgagaaggaggagaggagggtctggactatgcctcccatggccgtggccctgaagcctgtattgcagcagagccgggaagcaagggacgagctacctggagcgcctcctgttctttgcagttcctcctcagatcttagcctcctgttgggcccctcttttcagagccagcattctttccagcccctggagcccaaaccagacctcacttcatccacagctggggccttctctgcacttggggccttccatcccgatcatagggcagaaaggccattccctgaggaagatcctggacctgacggggagggcctcctaaagcaagggctgccgcctgctcagctggagggcctcaagaattttttgcaccagttgctggagacagtgccccagaacaatgagaacccttctgtcgacctgttgccccctaagtctggtcctctgactgtcccatcttgggaggaagcccctcaagtgccacgtattccaccgcctgtccacaaaaccaaagttcccttagccatggcatccagtcttttccgggtccctgagcctccctcctcccattcacaaggcagtggtcccagcagtggttccccagagagaggtggagatgggcttacattcccaaggcagctgatggaggtgtctcaactgttgcgactctaccaggctcggggctggggggctctgcctgctgaggatctcctgctctacctgaagaggctggaacacagcgggtacaagcctgggaggaaggaggaaggattctccgggtggaagctggattatggggagtggagtgggactgatggccgaggggataatgtccccagaaggaacacagactcccgcttgggtgagatcccccggaaagagattccctcccaggctgtccctcgccgccttgctacagcccccaagactgaaaaacctcccgcacggaagaaaagtgggcaccctgccccgagtagcatgaggagccgggggggagtctggagatgagcccccctaccctctctcctctttgttctctcattgttgttattttaataaatgctcattagtctgtatcagagtctctggctcataggaatttggaaaatagaggttttgtagggaatcacttcgtaaagaaaccacatttggttgagtactttttttatatgttacatgtttatatgtcatttcctgtgggaaaagacatgaatgctttggaagacggtctatgacaagatttggaaagttggggcggctaagattcagtggacaaagctaaaacctgcagagcaatgaactctgggtggtagtggaattatgggtgattcttagttttttaatacgtttctgtattttccaaattttctaaaacaagtatatgttactttaataatcagaacagacccaaacttta

SEQ ID NO: 528 - DNA, 2649 bp, Human
atctctcggcttccgttgagcaccaagcaagatggcagcttccgagacggttaggctacggcttcaatttgattacccgccgccagctaccccgcactgtacggccttctggcttctggtcgacttgaacagatgccgagtcgtcacagatctcattagtctcatccgccagcgcttcggcttcagttctggggccttcctaggcctctacctggagggggggctcttgccccccgccgagagcgcgcgccttgtgagagacaacgactgcctcagagttaaattagaagagagaggagttgctgagaattctgtagtcatcagtaatggtgacattaatttatctcttagaaaagcaaagaagcgggcatttcagttagaggagggtgaagaaactgaaccagattgcaaatattcaaagaagcattggaagagtcgagagaacaataacaataatgagaaggtcttggatctggaaccaaaagctgtcacagatcagactgtcagcaaaaaaaacaagagaaaaaataaagcaacctgtggcacagtgggtgatgataacgaagaggccaaaagaaaatcaccaaagaaaaaggagaaatgtgaatataaaaaaaaggctaagaatcccaagtctccgaaagtacaggcagtgaaagactgggccaatcagagatgtagttctccaaaaggttctgctagaaacagccttgttaaagccaaaaggaaaggtagtgtaagcgtttgctcaaaagagagtcccagttcctcctcggagtctgaatcttgtgatgaatctatcagtgatggtcccagcaaagtcactttggaggccagaaattcctcagagaaattaccaactgagttatcaaaggaagaaccctctaccaaaaatacaactgcagacaaactggctataaaacttggctttagccttacccccagcaagggcaagacctctggaacaacatcttccagttcagactctagtgcagagtcagacgaccaatgcttgatgtcatcgagcaccccggagtgtgctgcgggtttcttaaagacagtaggcctttttgcaggaagaggtcgtccaggcccagggctgtcatcacagactgcaggtgctgctggatggaggcgttctggctcaaatggtggtggacaggctcctggtgcttctcccagtgtgtctctccctgctagtttaggaagaggatggggtagagaagagaaccttttttcttggaagggagctaagggacggggcatgcgggggagaggtcgaggacgagggcatcctgtttcctgtgttgtaaatagaagcactgacaaccagaggcaacagcaattaaatgacgtggtaaaaaattcatctactattatccagaatccagtagagacacccaagaaggactatagtctgttaccactgttagcagctgcccctcaagttggagaaaagattgcatttaagcttttggagctaacatccagttactctcctgatgtctctgactacaaggaaggaagaatattaagccacaatccagagacccagcaagtagatatagaaattctttcatccttacctgccttgagagaacctgggaaatttgatttagtttatcacaatgaaaatggagccgaggtagtggagtacgctgtgacacaggagagcaagatcactgtattttggaaagagttgattgacccaagactgattattgaatctccaagtaacacatcaagtacagaacctgcctgagtatgacctctccaccttatagtttatgaatgtcttgtttgtgaaagtgactataacccaaacttttttttttttttaaagaggatttggaagttgtatggatttttttgttatcttcactttactgcataggaaacaatctacctcatcatttaaaatgacatgggtgtcggttttgtagatctttggtttttttgtcaggtttaatttcagttaacaaaatgtaaaacatgacattccctgcagatattgttgtataccagtatggtttcttctctttctttaaatgtttttggccatcaagtagcagtcgtcagtaggagtttataataccaagaatgtgctgcgtatcttgtctcaataagttttaagtaacatttaaaaatattaaagcatgttatttgacctaattttttagcatttgagttgttccattaaatggagcatcttgtaaatttcaagtattttatacttgcaattgttaagagttaacaggtagttggatttgtcgcagacaatgagttaaggaatcctttcacgtttttcccaactttaaaattaaggattctcaggtccctgtgtagagcagtgaaaataagatgtgcgtatgtgtgtgtatgcctggagaattggtgtttcacttcagtgagaggattggctgtgagcttcagaccaggaaatgtgtcatcttgccaggcacctggctgagtgtgctggagtgaggatcttgaacagaaacttccttttctgttattattcactacgaagctaaaatggccaaatatataccgtgaaaattggtttcatttaacaaaagatcagatccctccttcagctgtacacatttttaaataaaatcatattgaactaaaaaaaaaaaaaaaaaa

SEQ ID NO: 529 - DNA, 998 bp, Human
aggaggaggaggcaccaaacggcctgggtggatagaagggggacaaggaggcacacccaggccggcaaagagcaggtatcagcactgcaagcaccaagtgtgtcttgagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaacagataaaaaaaaaaaaaaaaaaaaa

SEQ ID NO: 530 - DNA, 2268 bp, Human
gtctcccctcgccgcatccactctccggccggccgcctgcccgccgcctcctccgtgcgcccgccagcctcgcccgcgccgtcaccatgagccaggcctactcgtccagccagcgcgtgtcctcctaccgccgcaccttcggcggggccccgggcttcccactcggctccccgctgagttcgcccgtgttcccgcgggcgggtttcggctctaagggctcctccagctcggtgacgtcccgcgtgtaccaggtgtcgcgcacgtcgggcggggccgggggcctggggtcgctgcgggccagccggctggggaccacccgcacgccctcctcctacggcgcaggcgagctgctggacttctcactggccgacgcggtgaaccaggagtttctgaccacgcgcaccaacgagaaggtggagctgcaggagctcaatgaccgcttcgccaactacatcgagaaggtgcgcttcctggagcagcagaacgcggcgctcgccgccgaagtgaaccggctcaagggccgcgagccgacgcgagtggccgagctctacgaggaggagctgcgggagctgcggcgccaggtggaggtgctcactaaccagcgcgcgcgcgtcgacgtcgagcgcgacaacctgctcgacgacctgcagcggctcaaggccaagctgcaggaggagattcagttgaaggaagaagcagagaacaatttggctgccttccgagcggacgtggatgcagctactctagctcgcattgacctggagcgcagaattgaatctctcaacgaggagatcgcgttccttaagaaagtgcatgaagaggagatccgtgagttgcaggctcagcttcaggaacagcaggtccaggtggagatggacatgtctaagccagacctcactgccgccctcagggacatccgggctcagtatgagaccatcgcggctaagaacatttctgaagctgaggagtggtacaagtcgaaggtgtcagacctgacccaggcagccaacaagaacaacgacgccctgcgccaggccaagcaggagatgatggaataccgacaccagatccagtcctacacctgcgagattgacgccctgaagggcactaacgattccctgatgaggcagatgcgggaattggaggaccgatttgccagtgaggccagtggctaccaggacaacattgcgcgcctggaggaggaaatccggcacctcaaggatgagatggcccgccatctgcgcgagtaccaggacctgctcaacgtgaagatggccctggatgtggagattgccacctaccggaagctgctggagggagaggagagccggatcaatctccccatccagacctactctgccctcaacttccgagaaaccagccctgagcaaaggggttctgaggtccataccaagaagacggtgatgatcaagaccatcgagacacgggatggggaggtcgtcagtgaggccacacagcagcagcatgaagtgctctaaagacagagaccctctgccaccagagaccgtcctcacccctgtcctcactgctccctgaagccagccttcttccatcccaggacaccacacccagcctcagtcctcccctcacagcctctgacccctcctcactggccatccctcgtggtccccaacagcgacatagcccatccctgcctggtcacagggcatgccccggccacctctgcggaccccagctgtgagccttggctgttggcagtgagtgagcctggctcttgtgctggatggagcccaggcgggagcggtggccctgtccctcccacctctgtgacctcaggcactagcctttggctctggagacagccccagagcagggtgttgggatactgcagggccaggactgagccccgcagacctccccagcccctagcccaggagagagaaagccaggcaggtagccagggggactagcccctgtggagactggggggcttgaaattgtccccgtggtctcttactttcctttccccagcccagggtggacttagaaagcaggggctacaagagggaatccccgaaggtgctggaggtgggagcaggagattgagaaggagagaaagtgggtgagatgctggagaagagaggagaggagagaggcagagagcggtctcaggctggtgggaggggcgcccacctccccacgccctcccctcccctgctgcaggggctctggagagaaacaataaagagattcacacacaagccaaaaaaaaaaaaaaaaaaaaaa

SEQ ID NO: 531 - DNA, 4491 bp, Human
agaagcccggatcgaagcgcagggtggcagccccggagccggggaatgtgaagagctctcggctgtgcagtggtaccgtcggggcctgggccgcgaaggatcttctgccacagctgcaacatgggcggcaagaacaagaaacacaaggctccagcggccgcggtggtccgggccgccgtgtctgcttccagagccaaatctgccgaggctggaattgccggggaggcccaaagcaagaagccagtgtccaggccggccaccgctgccgctgccgctgccggctccagggagccccgtgtcaagcaaggtccaaaaatttatagttttaattctacaaatgattctagtggtcctgcaaatctggataaatctattttgaaagtggtaattaataacaaactagagcaaagaattattggagtgatcaatgagcataaaaagcaaaataatgacaaaggaatgatttctggaagacttactgccaaaaaattgcaggatttatacatggctttacaagcattttcatttaagacaaaggacattgaagatgccatgaccaatacactcttatatggaggtgaccttcattctgccttggattggctctgtttaaacctttcagatgatgcacttcctgaaggattcagtcaggaatttgaagagcagcaacctaaaagtaggcctaaatttcagtctcctcaaatacaagccactatttcacctccattgcaacctaaaacaaaaacatatgaagaggaccctaagagtaagccaaaaaaggaagaaaaaaatatggaagtaaatatgaaagagtggattttacgatatgctgaacaacaaaatgaagaagaaaagaatgagaattctaaaagtttagaagaggaggaaaaatttgaccctaatgaaaggtacttacatcttgcagcaaaactgctggatgcaaaagaacaagcagctacctttaaactagaaaaaaacaagcaaggccaaaaagaggctcaggaaaaaataaggaaatttcaaagagaaatggaaactttagaagaccatccagtatttaacccagccatgaagatttcacatcaacaaaatgaaaggaaaaagcctcctgtagccacagaaggagaaagtgcattgaattttaatttatttgaaaaatctgcagctgctactgaagaagagaaagataaaaagaaagaacctcatgatgtaagaaattttgactatactgctcgaagttggactggaaaatctcccaaacaatttctgattgattgggtcaggaagaatcttcccaagagtccaaatccttcctttgaaaaagttccagtaggtagatactggaaatgtagggttagggtaatcaagtctgaagatgatgtcctggtagtatgccctacaatcttaacagaagatggcatgcaagctcagcacctgggagctactttagccctttaccgtttagttaaagggcagtcagttcatcagttacttcctcccacttaccgagatgtttggctggagtggagtgatgcagaaaagaaaagggaagaattaaataaaatggaaaccaataaaccacgtgatctttttattgccaaacttctgaataaactgaaacagcagcaacagcagcaacaacagcattctgaaaataagagagaaaactctgaagatcccgaggaatcttgggaaaatttagtttcggatgaggatttttctgcactgtccttggaatcagcaaatgtggaagatttggaacctgttagaaacctctttagaaagttgcaaagcacacctaagtatcagaaacttctaaaggaaagacaacagctacctgtatttaaacatcgggactcaattgttgaaactcttaaaaggcatcgggtagtggttgtggcaggtgaaacagggagtggtaaaagtactcaggtaccacattttctattggaagatttgcttctaaatgagtgggaagcaagtaaatgtaacattgtctgtacccaaccccgaagaatctcagcagttagtttagccaacagagtatgtgatgaattgggctgtgaaaatggacctggaggaaggaattccttgtgtggatatcagatccggatggaatctcgagcttgtgaatctaccaggttactctattgtacaacaggggttttgctaaggaaacttcaagaagatggtcttctaagtaatgtgtctcatgttattgtagatgaggttcatgaaagaagtgtccagtcagacttcctactaattatcttgaaggaaattttacagaaacgttctgatctacacttgattctaatgagtgccactgtggacagcgaaaaattttctacatatttcacacactgccccattctcagaatttcaggaagaagttatcctgttgaggtttttcatcttgaagatataatagaagaaacaggctttgtactggaaaaagactcagaatattgtcagaaatttctggaagaggaagaagaagtaaccattaatgttacaagcaaagcagggggaataaaaaaatatcaggaatacatcccagttcagactggagcacatgctgatttaaatccattttaccaaaagtacagcagccgcactcagcatgctattctatacatgaatcctcataaaatcaacctggatctcattttggaacttcttgcatacttagataaaagtccccaattcagaaatattgaaggagcagtattgatctttttaccaggacttgctcatattcagcagttgtatgatcttctatcaaatgatagaagattttattctgaacgatataaagtgatagctctgcattctattctttcaacccaagatcaagctgcagcattcacacttccccctccaggagtcaggaagattgttttagcaaccaatattgcagagacgggtatcactattcctgatgttgtatttgtaattgatactggaagaacaaaagaaaataagtaccatgaaagcagtcagatgagttctttggtggagacgtttgtcagtaaagccagtgctttgcagcgccagggaagagctgggcgggtcagagatggcttctgtttccgaatgtacacaagagaaagatttgaaggctttatggattattctgttcctgaaatcttacgtgtacctttggaggaattatgccttcatattatgaaatgtaatcttggttctcctgaagatttcctctccaaagccttagatcctcctcagctccaagtgatcagcaatgcaatgaatttgctccgaaaaattggagcttgtgaattaaatgagcctaaactgactccgttgggccaacaccttgcagctttacctgtgaatgtcaagattggcaagatgcttatttttggtgccatatttggctgccttgacccagtggcaacactagctgcagttatgacagagaagtctccttttaccacaccaattggtcgaaaagatgaagcagatcttgcaaaatcagctttggccatggcggattcagaccacctgacgatctacaatgcatatctaggatggaagaaagcacgacaagaaggaggttatcgttctgaaatcacatactgccggaggaactttcttaatagaacatcactgttaaccctagaggatgtaaagcaggagttaataaagttggttaaggcagcaggattttcatcttccacaacttctaccagctgggaaggaaacagagcctcacagaccctctcattccaagaaattgcccttcttaaagctgtactggtggctggactgtatgacaatgtggggaagataatctatacaaagtcagtggatgttacagaaaaattggcttgcattgtggagacggcccaaggcaaagcacaagtacacccatcctcagtaaatcgagatttgcaaactcatggatggctcttataccaggagaagataaggtatgccagagtgtatttgagagaaactaccctaataaccccttttccagttttactttttggtggtgatatagaagttcagcaccgagaacgtcttctttctattgatggctggatctattttcaggcccctgtaaagatagctgtcattttcaagcagctgagagttctcattgattcagttttaagaaaaaagcttgaaaatccaaagatgtcccttgaaaatgacaagattctgcagatcattacggaattgataaaaacagagaataactgaaactgaaattcatggtcaactgctttaaaaattaagatgaagatacagtcatgaaattatctgaaaatgggtcatcacattaagtatttcattacttaaaatgttggtactagccattaacttaaaggtggtgggaaaaaagcacatactttaaacatgtataattttctagttcctttttaatgatgattattctgaatgtatttgccactacatttacaataaattctttggtattatgcaaaaaaaaaaaaaaaaaaa

SEQ ID NO: 532 - DNA, 7896 bp, Human
ctcggtgcggttccgccgggcgcgaggagccgccgagacctccgcctgcgaacaaagaggaggccgtgcggggcgcggcgcccgcggagcatggcggaccgcagcctggagggcatggcgctgcccctggaggtgcgggcgcgcctggccgagctggagctggagctgtcggaaggtgacatcacacaaaaaggatatgaaaagaagaggtcaaagttaattggagcctaccttccgcagcctccgagggtggaccaagctttgccgcaagaacgccgggctcctgtcactccttcctccgcctctcgctaccaccgccgacggtcttcagggtcacgagatgagcgctatcggtcagacgtccacacggaagctgtccaggcggctctggccaaacacaaagagcggaagatggcagtgcctatgccttccaaacgcaggtccctggtcgtgcagacctcgatggacgcctacacccctccagatacctcttctggctcagaagatgaaggctcagtgcagggggactcccagggcacccccacctccagccagggcagcatcaatatggagcactggatcagccaggccatccacggctccaccacgtccaccacctcctcgtcctctacgcagagcgggggcagcggggctgcccacaggctggcggacgtcatggctcagacccacatagaaaatcattctgcacctcctgacgtaaccacgtacacctcagagcactcgatacaggtggagagaccgcagggttccacggggtcccggacagcgcccaagtacggcaacgccgagctcatggagaccggggatggagtaccagtaagtagccgggtgtcagcaaaaatccagcagcttgtcaataccctcaaacgaccgaaacgaccacctttacgagaattctttgtcgatgactttgaagaattattagaagttcaacaaccggatccgaaccaaccaaagccggagggggcccagatgctggccatgcgcggagagcagctgggcgtggtcacgaactggccgccgtcgctggaggccgcactgcagaggtggggcaccatctcgcccaaggcgccctgcctgaccaccatggacaccaacgggaagcccctctacatcctcacttacggcaagctgtggacaagaagtatgaaggtcgcttacagcattctacacaaattaggcacaaagcaggaacccatggtccggcctggagatagggtggcactggtgttccccaacaatgatccggctgccttcatggcggctttctacggctgcctgctggccgaggtggtccccgtgcccatcgaggtgccgctcaccaggaaggacgcagggagccagcagataggtttcttgcttggaagctgtggagttactgtagccttgactagtgacgcctgccataaaggacttccaaaaagcccaacgggagagatcccacagtttaaaggttggccaaagctgctgtggtttgtcacagagtctaaacatctctccaaaccgccccgagactggttcccacacattaaagatgccaataacgacactgcgtatattgagtacaagacgtgtaaggatggcagtgtgctgggtgtgacggtgacgaggactgcgctgctgacacactgccaggccctgacgcaggcgtgtggctacacggaagctgaaaccattgtgaatgtgctggatttcaagaaggacgtcgggctctggcatggcatcctgacaagcgtcatgaacatgatgcatgtgatcagcatcccgtactcgctgatgaaggtgaaccctctctcctggatccagaaggtctgccagtacaaagcaaaagtggcgtgtgtgaaatcgagggatatgcattgggcattagtagcacacagagatcagagagacatcaacctctcctctctgcgaatgctgatagtggcggacggcgcgaacccctggtctatttcttcttgcgatgcatttctcaatgtcttccaaagtaaaggccttcgacaggaggtcatctgtccttgtgccagctcgccagaggccctcactgtggccatccggaggcccacggatgacagtaaccagcccccgggccggggtgtcctctccatgcatggactgacctatggggtcattcgtgtggactcggaagagaagctgtccgtgctcaccgtgcaggatgtcggcctcgtgatgcctggagccatcatgtgttcagtgaagccagacggggttcctcagctgtgcagaacggatgagatcggggagctgtgtgtgtgtgcagttgcgacgggcacgtcctactatggcctctctggcatgaccaagaacacctttgaggtgtttcccatgacaagctccggggctccgatcagtgaatacccattcataaggacaggcttgctggggttcgtgggtcccggaggcctcgtcttcgtggtgggcaagatggatggcctcatggtggtcagcgggcgcaggcacaacgccgacgacatcgtggccactgcgctggccgtagaacccatgaagtttgtctaccggggaaggatagccgtgttctcggtgaccgtgctgcacgacgagaggatcgtgatcgtggctgagcagaggcctgactccacggaagaggacagtttccagtggatgagccgtgtgctgcaggcgattgacagtatacatcaagttggagtttattgcctggccttggtgccagcaaacaccctccccaaaaccccgcttggtgggatccatttatcagaaacaaaacagctttttctggagggctctctgcacccctgcaatgtcctaatgtgcccccacacctgcgtcacaaacttgcctaagcctcgacagaagcagccagaaatcggccctgcctctgtgatggtggggaacctggtctctgggaagagaatcgcccaggccagtggcagagacctgggtcagatcgaagataacgaccaggcacgcaagttcctgttcctctcagaggtcttgcagtggagagcacagaccaccccggaccacatcctctacacgctgctcaactgtcggggtgcgatagcgaactcgctgacctgcgtgcagctgcacaagagagctgagaagatcgccgtgatgctgatggagaggggccaccttcaggacggcgaccacgtggccttggtctaccccccaggaatagacctgatagcagcgttttatggttgcctgtacgcaggctgtgtgccaataaccgtccgtcccccgcacccacagaacatcgcgacgacgttgcctaccgtcaagatgattgtggaggtgagtcgctctgcctgtctgatgacgacacagctgatctgtaagttgctgcggtccagggaggcggcggcggctgtggacgtcaggacgtggcccctcatcctggacacagatgatttgccaaagaagcggcctgcccagatctgcaaaccttgcaacccagacactcttgcatatctcgacttcagcgtgtccacaactgggatgctagctggcgtaaagatgtctcacgcagccaccagtgccttctgccgttccattaagctgcagtgtgaactttacccctctagagaagtggccatctgcctggacccttactgtggactgggatttgtcctctggtgcctctgcagtgtgtattctgggcaccagtccatcctgatcccgccctctgagctggaaaccaaccccgccttgtggcttcttgccgtgagtcagtacaaagtccgagacacgttttgctcctactccgtgatggagctgtgcaccaaggggctgggctcgcaaacagagtccctcaaggcgcgagggctggacttgtcccgagtgaggacctgcgtggttgtggcggaagagaggcctcggatcgcactcacacagtcgttctcaaagctgtttaaggacctgggccttcacccgcgggccgtcagcacctcgttcggttgcagggtgaacctggcgatttgcttgcagggaacctcaggacctgacccaaccactgtctacgtggacatgagagccctgagacacgacagagtccgcttagtggaaagaggatcccctcatagtctgcccctgatggaatcgggaaagatacttccaggggttcggattataattgccaacccagaaacaaaaggaccgctgggggactcacaccttggagagatttgggttcacagtgcccacaatgccagcggttatttcactatttacggagacgaatccctccagtcagatcacttcaactcaagactaagttttggagacacccagaccatctgggcacgcacaggctacttggggttcctgcggagaactgagctcacagatgcaaatggagagcgccatgatgccctctacgtggtaggggcactggacgaagccatggagctgcggggcatgcggtaccacccaatcgacattgagacctcggtcatcagagcccataaaagcgttacggaatgtgctgtgtttacctggacaaatttgttggtggttgtggttgagctggatgggtcggaacaagaagccttggacctggttcccttggtgaccaacgtggtcctggaggagcactacctgatcgtcggagtggtggtcgtggtggacatcggcgtcatccccatcaactcccgtggggagaagcagcgcatgcacctgcgagacgggtttttggcagaccagctagaccccatctatgtggcctacaacatgtagtctcgtctcttggcttccatggacttttctagagatgtagacattgttctccgtgtccactgaagcgtgcagacacagggcaacactcaccagaatacagccatttgtggtgagagtggaggaggaagaggaggaggaagaggacttctcacagcagccacgattggcatgggggtgaaatgtgaatttaccactgaatttcgctcagaaggactttggattactgccttcagtttgttggaaaagcccatttcaaaactttcttttcttttctttcttttttaattattggataataagtgctttcttcgtaaatgtggtattttgttaagccgaaatagcaattaaaaaaatatcctgccctccagatgggttcttttaaacaatttatgtagtgtgacaaagaattgttttctctgttttaatgtgtcatgaaatcttaatgacatggatctgttactaatttaagccattgctagatctcatccttttaggaaagtttgaggtacgagaaaaccttccaaatagcaccttccaattagataatagcagctttctttgtcagaaatgtgctgaagaaacaaaggctggtatacggccttcgaagttagtatagaatgagaagaaattataaataaggtgtatttcggcaattatcttgcaaatatctttgtactaaactaaaaagataaaataagttaacttcctcaatatgtaattatgtacaaaacgtttaatttattttgatctctttagaactataaaagagaaaaacattcaagaatattaaagtcttgtaatgtttgctaatataaaaaagtgttgtattatcttgcgtggatagtatcacaacaaatatatatatatgaaatataaattcactaatgaacaaaggagattttaaagtttaagatgcagaacttgtcacttgcatggtgtgccccccgtactcacatacactctgctgttgccagcagtcgcagaccgcaggagccctgtctaaaagtttcttctagaaccagagaccagcaagtgaaattattgccatctcaaggatggcaaaagaattcaaagctcaatgtgcactatttttttctttgctgtgggacaacagtgaatgtgtttatgccagcgtgtgctgatgatactgaggggctttaggttggcaaatagcactgttttcttagctgcaagaattcattgcacaatgtttttcatcatttttgttaatgtcatctttttttggtccttgctacgaaaaggaatgcgattctgtggtcattcgcactgggttgcattgattccccctctgatggccaatgtggagtggacaaagtgtccggaactcacatcggtgatcgtcccctcgtcttaagacccagcccgctctgtgtgagcctctggggctccctcgctcagtgagcacagttccccgggggttcatgccagagctccggctgaagcaagaagtcctccagctgcgtcgtttgccgcctgtggacgagtgcgccccagtttctgccctggcagctcctggccacaccttctcagagctcacctgtgcacttctaaattgaattggcccacggtgtccaaccaagaaggagcatctgcactccgagaaagatgtgttctgtaactgccccagtgtgaccccgcagtggctctcggtgctagatatgcatgactaagattgatgctgggcaaaatgtagatgatctttcattatgttgtgggcagcgtctttctctgcctttgctatatgcagtcagcagtaagccttttgctaaaagagttttgtttgacttctgagatccaaggctgattgttgttaaaaaaaaaaaaaaaaaaaaagtggcacatttaaaaaaatgtgtctgcatatgtggtgcatccttccatctccacaaaccatttgattcttgaaatattgtttgacctcattgctgtgtgtgaatatttctccacatgcttcagatgcacattcctagtctctgcttcctaaggggggaaccaccacacattggggggaaaaaagacattttcctacacccacccaccttgttgaaagggaggtaggtttggggcttcaggccaggcactgactatgaaacattagctgcagtgtgcaggacagctttgaggtccagctgaagtcaggaagcaaaacaaatgtagatgtcacttcaaacataatttcaactgtcaccagatcaactctacattcaaggagtgtggacgctgcagtgcagttgtgagggcagttagcagccgcctcttctgcatcctgtcaactctgattagttagagtttaggctcaaaagagttggtggactgagattgaaatttggttgtgcaagagaaaggaaaggagacacttagtaccaccagtttcagcaataaagaagggtcattctgtattcaaaattgtactgtagataaatcattcatgagattgtaaaaaatgtttgtcttgtgaccttgtgcttttgaagtcagacaaaaccgtgtaatcaacttgcacaaaaagagggtacacagtgaacatataaacacagacctaatcaaacaggagcagattcctcatggtgcttgtttattatatatatttaatcctgcttgacactttacccaagggagatggtcccttttatcagttgaatgttagcagcgttatttcagagtgtggtgactggttagagaaactcatgtactcaaccagccacagtttcaaacaaaatttttatgtgcaaaggacagcaaccttcttgtatgttaaaccaccagtacgctttgtacatctgtgataacgcctgttttatattcaaatgaacaaataaaagcttttatttttgttgctctgaaaatagcagtttcttaattggtcccctggaaagatgtctgggacagctttaatcccgggaaggaagtgactcctacagggaaatgtatctgactctgtttacataatttgttgcattacttagtacagataatcatactttgaaaaatgtttaaattttgatgtgggcatttattgctaaaaataattcctatggcaacaaatgttttgtgaaatgttttttttaattcttttaaatatatctaaatatatttgttcacattttgctgcaa

SEQ ID NO: 533 - DNA, 3222 bp, Human
gagcggcttcctgcaaaccttccctggcatctggagggaccaccgttgccgcgtcttcggcttccacgatctgcgttcgggctacgcggccacggcggcagccactgcgactcccactgtgcctggctctgtccatattagttcccaggcggccgtcgccgttccagcagcggcagcggcagcggcagcggcggacatgttgtgaggcggcggcgcgggtgtctgaaggatggtttggccgaggcggcggcaacggctgctggcggcggcggcagcggcagcggggcctcgggctctatagagccgagcccgctgggtacccgcccggtaccgcggcgaggccagtgcccctggatcttgcctctgctccgacgccgttggggaccagttaggcgacagcgcccgcccctctgaggagacacgaaggtggttccccagccgctcaaatttccggaccaccgcgctttcccctcctcagcctgggctgtgctctctctagaatcctcgggcccccactttcttcccaaactcatcctaaatctctcacacacgcgagtgttcccagccctcaagccagctgctcctccgttcattttctgcaccctcttcgcaaagcaccccccgggatcactctccgagggcgactttttgagaaatctcggtggagtagtggaccagagctggggagtttttaaaagccggggcgcgagaaacaggaaggtactatggcttcctcgtctggcaacgatgatgatctcactatccccagagctgctatcaataaaatgatcaaagagactcttcctaatgtccgggtggccaacgatgctcgagagctggtggtgaactgctgcactgaattcattcaccttatatcttctgaagccaatgagatttgtaacaaatcggaaaagaagaccatctcaccagagcatgtcatacaagcactagaaagtttgggatttggctcttacatcagtgaagtaaaagaagtcttgcaagagtgtaaaacagtagcattaaaaagaagaaaggccagttctcgtttggaaaaccttggcattcctgaagaagagttattgagacagcaacaagaattatttgcaaaagctagacagcaacaagcagaattggcccaacaggaatggcttcaaatgcagcaagctgcccaacaagcccagcttgctgctgcctcagccagtgcatctaatcaggcgggatcttctcaggatgaagaagatgatgatgatatctgaaattcaccagctgagtttctatttcttctataaatgtttttccctgcacaacaaaaacagtgaaagaaatgcttatctgtaattttgtatgcatcttggtggacttgtcattggtattctagggatgtctgctattaagtttcatctattgtgtgctatacatgtaaaaactgtctctttgaactattgaaaatttaaggttcagtataatatcaattttgaatttttaatggtgtttatgaaattttagatagcagcgagtccttcgtttgatcaataaacagtgttacagataacttcaagtttataaaaatacagtgaaatttctacaaagctctaaatctgcatttgcatttcctctgcccttttaactaaactaaaacttgtgaattttaaattattaaggggggggtgctgtgtgaatcagtagacattggattgggttggtgaaagagttcagttctgtagtatctgaatttgtcttttaaaatgagtacatatataggcaataaatatatatgctcagatcaatatacttgtttagaaaaacttcaagacattcaaaaactaggaaggagtatgtttaatagtatttgtataaatttggtggttatgtttttttattttgtttctgttttgtgtagaggtaaaaactatagttttattacagcataattcattttgagctccactatgacatttcaaagactgcccagtttggaagtctgtcatgatttttactctttcactccaattcagtaattgttgatagtattacttacctagtccatccatactcatattattcaaatatataggtggtacttttgaaacaattacattggttctcttggtttaactgaggtttatgaatattcaaacctttgctgggggaaagaaatgaaagttaatgagcatgcttgctatgagagagggatttttaatttaacttgtagttatagtttacttattgtttttagaattacttttacattttcccaactagatggcctagagtccaacattaccttttgagatgacattattgtctccataattgagtgatagctttaaaaaaaagattagttttgcttaagaagttatgttacaactgatcagccctatatgaattaactgatcagccctatatgaaacataagttgtgttataacttatcagccgtatatggaacataaatagtttctacctgcttgttagagaagctttaatttggttctaataaatacagtatggtagtgtttataggaatccaggatgttgaagaaatggcataatgtctatattttggaaacagaaaggaaaagtcacttaagatagtattaagtaattaaattcctatgtcagttgccaaatcttttaaacttatgtattcaccaagcccaaaaatagattgtggctcccaggattccaattttaattggagagctaagtaagtaaagttttataactgttaggtttcttaatgatcatattttgcagttttagtaaaagggaaatattgttatacatttattaaatatacttcccccatgaagtgaaaaggttaattttgctgaatgttttaagttgaagttacttcatggatgtcatacccatgaagtgcatttggatgagatagaagaaattgttttttaaaaagtttaagtaccaaaggtagtctagtctagaacgataagttaatacgtgttggcttttctaatttgtactgtaacatccttatactttctattttaagtatatctgtttcttaagtaaacaacttagatattttccacacctttttttttttttctgatgcagagttcaggttaatattttactgcatctgataatgtattatacgtttgaagcctagtgacttttcattttgacattcttgtgatttcatatgctgtattcttcaagcaataaaattgtgatgtgttttataaaaaaaaaaaaaaaa

SEQ ID NO: 534 - DNA, 2096 bp, Human
gcctttgcgcacgcgcacgaacgcacggccgcgcagcatctgtcttgctggaagctttttcctagaggttgagcggtttgcacaatgtcggaaatggctgagttgtccgagctgtatgaagagagcagtgacctgcagatggatgtgatgcctggcgagggtgaccttccgcagatggaggtaggcagcgggagccgggagctatccctgcgtccctcccgcagcggggcccaacagctcgaggaggaaggcccaatggaggaggaggaggcccagccaatggcggcgccagaggggaaacggagccttgctaacgggcccaacgctggggagcagccaggccaggtggcgggcgcagacttcgagagcgaggacgagggcgaggaatttgatgactgggaggacgactacgactatcccgaagaggagcagctcagtggtgccggctacagagtatcagccgctcttgaagaagccgacaagatgtttctgagaacaagagaaccagccctggatggcgggtttcagatgcattatgagaagaccccgtttgatcagttagcttttatcgaagagcttttttcactgatggttgtcaatcgtctgaccgaagaactcggctgtgatgagattattgatagagagtagttagatgctgttaaaagaggaggaaactacttgaggagggacccaactttccgctatcttttgggttcattccaaatagttttgtgccattgaaaaacttgaccttcaaaaaaatttgtttttcagaatagaacacaataggacagtgactgcacagttgtgaaaaaggaagagaatcattaaagaaaaagaaaaaagattttaagaccgttgaaatcaattatcaagaacgtcctaaaacacctatggctttgactttgttattgatccagattattttccttgcattggggaaaatatctttcatatttgtttgctgtaaagatggttttgcaagaataagtcatgaccaagacaaactgccaatacaaaagcccactgatactaattatataatgagaaaaaaatgtatccaactaggacacatatcttttgagttatttggactgaaagcttaagaaaacttggaaaattctattttgtgatctagtcaagccacagttatcaaaggctacattttcagtgtaagataaatggatgagtaaactcaaatatgtatcacgtgtgctttgtatcttaagatgtgtttccaagagcatctgaaattttgtttgtacatgtatcttgatcatttataaagccactgtgatctataaatcaagaaaatccattgtcataaccatttttaaaagtcaaaaattaagacatccttaattaaaaagtttcaaatctagacactaaatgtgtgtgaatgtacaaagaaaacaaaccattgcttatgctgttatatactagagaaattttgttttgcttgctgttttaacttgacagatgaaggactttagttgaacttcatattgtaagaactgttaataaaagttgtcaagtaaaaagcgctatatctaaaaagactttatgaacagttattctatcaacttttaaaggttttaaacctgcccagaaattaccttggtatctgaagtttccctctgtctcctcctctaattaagcttgttatttgtcatgcaccagcattggagataataaaatttcttgttctgtgtattttgtttggctaatagtattgcatacatactttctctgtatactactttctattgtatgtgttaaccagtattaagggaaaatgatccagcttcagctatctaattcacaaattaatttctggaaattaaactttgtaaattaagtttttgcctataagaatttgctggtctgggaaaacctgccctatcaatgagtatgttgccgtggttaccttactaagatgctgaagttctaggagagtaatgattacatcagaaggctaggttcagcaaaataagtgtatcagcaggttttatcatgatcagtaaaaatgttccaaatgcttctgctccattatagcagtaaagaacgaatatccaatgcaacaggacaattaaaaa

SEQ ID NO: 535 - DNA, 3206 bp, Human
agtgctgggcgagtgggcggggccggctgttggcggcggttggctcggcgcgggagtcggctgcacgtgcgggcgggggcgatgcgtcactgatcggaggaacgagaatgaatatgactcaagcccgggttctggtggctgcagtggtggggttggtggctgtcctgctctacgcctccatccacaagattgaggagggccatctggctgtgtactacaggggaggagctttactaactagccccagtggaccaggctatcatatcatgttgcctttcattactacgttcagatctgtgcagacaacactacaaactgatgaagttaaaaatgtgccttgtggaacaagtggtggggtcatgatctatattgaccgaatagaagtggttaatatgttggctccttatgcagtgtttgatatcgtgaggaactatactgcagattatgacaagaccttaatcttcaataaaatccaccatgagctgaaccagttctgcagtgcccacacacttcaggaagtttacattgaattgtttgatcaaatagatgaaaacctgaagcaagctctgcagaaagacttaaacctcatggccccaggtctcactatacaggctgtgcgtgttacaaaacccaaaatcccagaagccataagaagaaattttgagttaatggaggctgagaagacaaaactccttatagctgcacagaaacaaaaggttgtggaaaaagaagctgagacagagaggaaaaaggcagttatagaagcagagaagattgcacaagtggcaaaaattcggtttcagcagaaagtgatggaaaaagaaactgaaaagcgcatttctgaaatcgaagatgctgcattcctggcccgagagaaagcgaaagcagatgctgaatattatgctgcacacaaatatgccacctcaaacaagcacaagttgaccccggaatatctggagctcaaaaagtaccaggccattgcttctaacagtaagatctattttggcagcaacatccctaacatgttcgtggactcctcatgtgctttgaaatattcagatattaggactggaagagaaagctcactcccctctaaggaggctcttgaaccctctggagagaacgtcatccaaaacaaagagagcacaggttgatgcaagaggtggaaatgttctccatatcaagatgtggcccaaggggttaagtgggaacaatcattatacggactcttcagatttacagagaacttacacttcatctgttccacctctcctgcgatagtcctgggtgctccactgattggaggatagagccagctgtctgacacacaaatggtcttttcagccacagtcttatcaagtatcctatatgtattcctttctaaactgctactcatgaatgaggaaagtctgatgctaagatactgcctgcactggaatgttaaacactaaatatataacaagctgtgttttcctaagctgagatctgttgaataatgtttacattcgtcccccggggaaatgtatgctcagccaccattcaagagatgactgagaaggagatggtaagttcaagaagactgattgcacctgggacccaggccctttctttgggatccagtcccagccttcatccatgtgattaagatccaggccgctgaagttccccaggaaatgatcttccacttgagcaaccttttacttgatacgatttgcacctttctgttttcctgcagtcagggtggtggcctgcagggacctgagctttgctacccaaccagattcctcatagagattcctaatcactagtttcttgtattcataaactcagagatacagagggcttggtttgaagttggggtgagatgaaacctttgctctgagccaaagctctggggccttgcattccctgcattgggttgatgactgtcagcatcactgccgcaggccatgcttgactaaggtacctggttttagccacagccacctccttgtatgttacctttcagctctggccaagagtgggacagggttttaaccacaaataggagcagcatgcaattcctagtgacttgctgcacagtattgtatcataattacaggaagtttttatttttaaaactggatctggggtatattcatttgccccatcacctctgtctaaaggcccaagtcctagggctgccatggtcacaagcacactgatgctccttaagattgtttatctggagcccacatagtgtggaacaaaaagtcacctagaaagcatccttggtcatcattgtctccttcccacctggcccagagatgcttaaatccaagttgtttctccagctgtcacctcccccaggagatcaggattccactgacgtcctgggcagccagtgaatttaattttccatgagaaacaacagagttaacctgtggcattaggagacctacttcatgtggaccctttttttccttcagtttaacttttctggagcagtgtgctgcgtagttcggcctgagtttgtgcagcttgttaagacaactcttgtgtacgctatgttgaagctcaacaaaaaagtcatgggaccacttctagaaatctttcagctgtcaggcctgtcagtctcatgacagtttgttggttgtgccaaacactttatttgggaaaggaaagcccagatttgaatgggtctttcccctgggccttatcctatagaggcatttgtaatatggagaaaataatttttcatttttgctcatttaattctataaattctctttataaatgaattttgtgttctttagttctccttaaaagaacttttgaattataaaaataaaatctttacctgtcgaattgttgctgcagatgattgttgtggaaaatctggatcattgacctctgtgctttcattcctagagatgttttatagttacatgagcaaaagctgttgccccaaagtgatggccctggaggcggggctgaggaacagggaaatgccgctgtgaagtcttaaagcacttctgcttaaactcccatgtgtgaggagtgtgcctccctgtgccctctcagctctgaggctggccgtctttcggggtgttccttttggcaaatatacactgtaatcttgagtctaaatttatatgttgaaatgctaccttttttaaaataagaaactaaataaaattattttactatcagtgaaaaaaaaaaaa

SEQ ID NO: 536 - DNA, 1095 bp, Human
aacttcctgcgcggttgctatggttccgagggcaggactatgggaggctgccctgtacggaaaagaagaagaaatggcagtaaagagggcaaccatcattccacccagcccaaaaggaataagagaaaccctatctttcaggattctcaagatacagaggtattttcatggagtgataatgaaaggagcagcagccgcattaatatcccagagagagcaagtggaccagaaggcaacttaaaccagattgttactgaacccgatgcaaactttccccagttcttgcatgagggattgtctaaacctgtttatgtcataaactggtttatgtcctttggtcctgaaataaaactcaatacttcacagcagggaaggaaccaagctgtttaaaactacttatctccgctatgaaggagaagtattttcaaggaatatcagaagaaagtagaaagtgagaggaggttccagctgggcttcctgggtcaagtaggggctcagaaagctgtgaaactcactcatttcctgcatgcggacttactttggtcctggatgaataatattgaagatatgtgcttaaaacattcctaacatcagaatttgcgcctgtgttttcttccccaagaaagctataaacagcgaaaattttgttgtaagcttccctgtgtcctctctccctctctcccttccccctcccctgaaactaaaaggaatgttaaaagcccacttttctgtgaccagcagaccttatctatggtcccaattccaattccttgtaaacacaatttgtaaaatcccgtgagatcctgtctcctttgccatcccgctgcaaggttataagtagagaaaacttaagttacaattccagttttcctcaagatctgagacatgttaattgtctttgtttctccctctggtaacatcttcccaccacacatatttcctgccttagagagtttaaaaggtgataaaaaaatctaacactggctaccccgctcgggaccccttccacgctgtgaaagctttgtactgtcactctgcttaataaagcctacagcttttttactctcaaaaaaaaaaaaaaaaaaaaaaaaaaaa

SEQ ID NO: 537 - DNA, 3134 bp, Human
cggaatctacaccttcccggccagcggtagcaactgcagaactgcaggagactatctttctagacaaggcagttgaggaggagggagcgcttgagggggactggcctggcgtgcactccgcacctcggggacattattgcgcgtggaacggctgcttttggaaggcacaacttcctgaatggaccatgactcccaccaaagatccctgtctctgattcaccaaacagcttcaaccctgaaaccaggacgagaagttgacaacatctgagtggacagctaattgacctaagacttcagaccaggcctactattgcccagaagaaaagatgtttggttttcacaagccaaagatgtaccgaagtatagagggctgctgtatttgcagagctaagtcctccagttctcgattcactgacagtaaacgctatgaaaaggacttccagagctgttttggattgcatgagactcgttcaggagacatctgcaatgcctgtgtcctgcttgtgaaaagatggaagaagttgccagcaggatcaaaaaaaaactggaatcatgtggtagatgcaagggctggacccagtctaaagactacattgaaaccaaagaaagtgaaaactctatctgggaacaggataaaaagcaaccagatcagtaaactgcagaaggaatttaaacgtcataattctgatgctcacagtaccacctcaagtgcctccccagctcaatctccttgttacagtaaccagtcagatgacggctcagatacagagatggcttctggttctaacagaacaccagttttttcctttttagatctcacttactggaaaagacagaagatatgttgtgggatcatctataaaggccgttttggggaagtcctcattgacacacatctcttcaagccttgctgcagcaataagaaagcagctgctgagaagccagaggagcaggggccagagcctctgcccatctccactcaggagtggtgactgaggtttttatgtagaaggggaacaaaaaaaaaaatatctgaattttgaaaaaccacaaagctacaaactgaccctcttttttttttgagacggagttttgctcttgttacccaggctggagtgcagtggcgtgatcttggctcactgcaacttccgtctcccgggttcaagtgattctcctgcctcagcctcccaagtagctgggtttataggtgcccgccaccagacccggctaattttttagttttagtagagacggggtttcaccacgttggccaggctggtcttaaatgaccctcttatttttaacttggatacctgctattctgccaaaagacaatttctagagtagttttgaatgggttgatttcccccactcccacaaactctgaagccagtgtctagcttactaaaaaaagagttgtatataatatttaagatgctgagtatttcataggaaagctgaatgctgctgtaaagtgctctttaagtcttttttttttttaatccccttctaatgaatgaaactaggggaatttcaggggacagagatgggatttgttgtatgataaactgtatgtagtttttagtctttctgttttgagaagcagtggttggggcatttttaagatggctggctactcttgttttccctcatgataataaatttgtcataactcagtaacatgaacttgcccctagaggtagttgttaataattttgaaatattaaggtcttgccaagcttctgatgattcacacctgtactactgattattaagcaggacagactgagctttctgttgcaaataccttggaggagaaagtaatttctaaatatacagagaggtaacttgactatatatgttgcatcctgtgcctcccttcatattaatatttgataaagattttaatttatgtaaaacttctaaagcagaatcaaagctcctcttggggaaatggcaagtctttaggataggcaagaccctgtatgaatagtaccaaagcattaccgcatggtagagaacacactcgattaaaaatgttaagctatctgaaaaataaaatgtgcaagtcttcaggatggcacaaaacaaaggttaatgcttcttggggcacatttcttagagggcttgctgagtgtgtaaatataatcgacttttgtttgtgttacatgacttctgtgacttcattgaaaatctgcacaattcagtttcagctctggattacttcagttgacctttgtgaaggtttttatctgtgtagaatgggtgtttgacttgttttagcctattaaatttttattttctttcactctgtattaaaagtaaaacttactaaaagaaaagaggtttgtgttcacattaaatggttttggtttggcttcttttagtcaggctttctgaacattgagatatcctgaacttagagctcttcaatcctaagattttcatgaaaagcctctcacttgaacccaaaccagagtactcttactgcctcttttctaaatgttcaggaaaagcattgccagttcagtcttttcaaaatgagggagaaacatttgcctgccttgtaataacaagactcagtgcttattttttaaactgcattttaaaaattggatagtataataacaataaggagtaagccaccttttataggcaccctgtagttttatagttcttaatctaaacattttatatttccttcttttggaaaaaacctacatgctacaagccaccatatgcacagactatacagtgagttgagttggctctcccacagtctttgaggtgaattacaaaagtccagccattatcatcctcctgagttatttgaaatgattttttttgtacattttggctgcagtattggtggtagaatatactataatatggatcatctctacttctgtatttatttatttattactagacctcaaccacagtcttctttttccccttccacctctctttgcctgtaggatgtactgtatgtagtcatgcactttgtattaatatattagaaatctacagatctgttttgtactttttatactgttggatacttataatcaaaacttttactagggtattgaataaatctagtcttactagaaaataaaaaaaaaaaaaaaaaa

SEQ ID NO: 538 - DNA, 8481 bp, Human
gagagacggcagcggccccggcctccctctccgccgcgcttcagcctcccgctccgccgcgctccagcctcgctctccgccgcccgcaccgccgcccgcgccctcaccagagcagccatggaggaggtggtgattgccggcatgtccgggaagctgccagagtcggagaacttgcaggagttctgggacaacctcatcggcggtgtggacatggtcacggacgatgaccgtcgctggaaggcggggctctacggcctgccccggcggtccggcaagctgaaggacctgtctaggtttgatgcctccttcttcggagtccaccccaagcaggcacacacgatggaccctcagctgcggctgctgctggaagtcacctatgaagccatcgtggacggaggcatcaacccagattcactccgaggaacacacactggcgtctgggtgggcgtgagcggctctgagacctcggaggccctgagccgagaccccgagacactcgtgggctacagcatggtgggctgccagcgagcgatgatggccaaccggctctccttcttcttcgacttcagagggcccagcatcgcactggacacagcctgctcctccagcctgatggccctgcagaacgcctaccaggccatccacagcgggcagtgccctgccgccatcgtggggggcatcaatgtcctgctgaagcccaacacctccgtgcagttcttgaggctggggatgctcagccccgagggcacctgcaaggccttcgacacagcggggaatgggtactgccgctcggagggtgtggtggccgtcctgctgaccaagaagtccctggcccggcgggtgtacgccaccatcctgaacgccggcaccaatacagatggcttcaaggagcaaggcgtgaccttcccctcaggggatatccaggagcagctcatccgctcgttgtaccagtcggccggagtggcccctgagtcatttgaatacatcgaagcccacggcacaggcaccaaggtgggcgacccccaggagctgaatggcatcacccgagccctgtgcgccacccgccaggagccgctgctcatcggctccaccaagtccaacatggggcacccggagccagcctcggggctggcagccctggccaaggtgctgctgtccctggagcacgggctctgggcccccaacctgcacttccatagccccaaccctgagatcccagcgctgttggatgggcggctgcaggtggtggaccagcccctgcccgtccgtggcggcaacgtgggcatcaactcctttggcttcgggggctccaacgtgcacatcatcctgaggcccaacacgcagccgccccccgcacccgccccacatgccaccctgccccgtctgctgcgggccagcggacgcacccctgaggccgtgcagaagctgctggagcagggcctccggcacagccaggacctggctttcctgagcatgctgaacgacatcgcggctgtccccgccaccgccatgcccttccgtggctacgctgtgctgggtggtgagcgcggtggcccagaggtgcagcaggtgcccgctggcgagcgcccgctctggttcatctgctctgggatgggcacacagtggcgcgggatggggctgagcctcatgcgcctggaccgcttccgagattccatcctacgctccgatgaggctgtgaagccattcggcctgaaggtgtcacagctgctgctgagcacagacgagagcacctttgatgacatcgtccattcgtttgtgagcctgactgccatccagataggcctcatagacctgctgagctgcatggggctgaggccagatggcatcgtcggccactccctgggggaggtggcctgtggctacgccgacggctgcctgtcccaggaggaggccgtcctcgctgcctactggaggggacagtgcatcaaagaagcccatctcccgccgggcgccatggcagccgtgggcttgtcctgggaggagtgtaaacagcgctgccccccgggcgtggtgcccgcctgccacaactccaaggacacagtcaccatctcgggacctcaggccccggtgtttgagttcgtggagcagctgaggaaggagggtgtgtttgccaaggaggtgcggaccggcggtatggccttccactcctacttcatggaggccatcgcacccccactgctgcaggagctcaagaaggtgatccgggagccgaagccacgttcagcccgctggctcagcacctctatccccgaggcccagtggcacagcagcctggcacgcacgtcctccgccgagtacaatgtcaacaacctggtgagccctgtgctgttccaggaggccctgtggcacgtgcctgagcacgcggtggtgctggagatcgcgccccacgccctgctgcaggctgtcctgaagcgtggcctgaagccgagctgcaccatcatccccctgatgaagaaggatcacagggacaacctggagttcttcctggccggcatcggcaggctgcacctctcaggcatcgacgccaaccccaatgccttgttcccacctgtggagttcccagctccccgaggaactcccctcatctccccactcatcaagtgggaccacagcctggcctgggacgtgccggccgccgaggacttccccaacggttcaggttccccctcagccgccatctacaacatcgacaccagctccgagtctcctgaccactacctggtggaccacaccctcgacggtcgcgtcctcttccccgccactggctacctgagcatagtgtggaagacgctggcccgcgccctgggcctgggcgtcgagcagctgcctgtggtgtttgaggatgtggtgctgcaccaggccaccatcctgcccaagactgggacagtgtccctggaggtacggctcctggaggcctcccgtgccttcgaggtgtcagagaacggcaacctggtagtgagtgggaaggtgtaccagtgggatgaccctgaccccaggctcttcgaccacccggaaagccccacccccaaccccacggagcccctcttcctggcccaggctgaagtttacaaggagctgcgtctgcgtggctacgactacggccctcatttccagggcatcctggaggccagcctggaaggtgactcggggaggctgctgtggaaggataactgggtgagcttcatggacaccatgctgcagatgtccatcctgggctcggccaagcacggcctgtacctgcccacccgtgtcaccgccatccacatcgaccctgccacccacaggcagaagctgtacacactgcaggacaaggcccaagtggctgacgtggtggtgagcaggtggctgagggtcacagtggccggaggcgtccacatctccgggctccacactgagtcggccccgcggcggcagcaggagcagcaggtgcccatcctggagaagttttgcttcactccccacacggaggaggggtgcctgtctgagcgcgctgccctgcaggaggagctgcaactgtgcaaggggctggtgcaggcactgcagaccaaggtgacccagcaggggctgaagatggtggtgcccggactggatggggcccagatcccccgggacccctcacagcaggaactgccccggctgttgtcggctgcctgcaggcttcagctcaacgggaacctgcagctggagctggcgcaggtgctggcccaggagaggcccaagctgccagaggaccctctgctcagcggcctcctggactccccggcactcaaggcctgcctggacactgccgtggagaacatgcccagcctgaagatgaaggtggtggaggtgctggctggccacggtcacctgtattcccgcatcccaggcctgctcagcccccatcccctgctgcagctgagctacacggccaccgaccgccacccccaggccctggaggctgcccaggccgagctgcagcagcacgacgttgcccagggccagtgggatcccgcagaccctgcccccagcgccctgggcagcgccgacctcctggtgtgcaactgtgctgtggctgccctcggggacccggcctcagctctcagcaacatggtggctgccctgagagaagggggctttctgctcctgcacacactgctccgggggcaccccctcggggacatcgtggccttcctcacctccactgagccgcagtatggccagggcatcctgagccaggacgcgtgggagagcctcttctccagggtgtcgctgcgcctggtgggcctgaagaagtccttctacggctccacgctcttcctgtgccgccggcccaccccgcaggacagccccatcttcctgccggtggacgataccagcttccgctgggtggagtctctgaagggcatcctggctgacgaagactcttcccggcctgtgtggctgaaggccatcaactgtgccacctcgggcgtggtgggcttggtgaactgtctccgccgagagcccggcgggaaccgcctccggtgtgtgctgctctccaacctcagcagcacctcccacgtcccggaggtggacccgggctccgcagaactgcagaaggtgttgcagggagacctggtgatgaacgtctaccgcgacggggcctggggggctttccgccacttcctgctggaggaggacaagcctgaggagccgacggcacatgcctttgtgagcaccctcacccggggggacctgtcctccatccgctgggtctgctcctcgctgcgccatgcccagcccacctgccctggcgcccagctctgcacggtctactacgcctccctcaacttccgcgacatcatgctggccactggcaagctgtcccctgatgccatcccagggaagtggacctcccaggacagcctgctaggtatggagttctcgggccgagacgccagcggcaagcgtgtgatgggactggtgcctgccaagggcctggccacctctgtcctgctgtcaccggacttcctctgggatgtgccttccaactggacgctggaggaggcggcctcggtgcctgtcgtctacagcacggcctactacgcgctggtggtgcgtgggcgggtgcgccccggggagacgctgctcatccactcgggctcgggcggcgtgggccaggccgccatcgccatcgccctcagtctgggctgccgcgtcttcaccaccgtggggtcggctgagaagcgggcgtacctccaggccaggttcccccagctcgacagcaccagcttcgccaactcccgggacacatccttcgagcagcatgtgctgtggcacacgggcgggaagggcgttgacctggtcttgaactccttggcggaagagaagctgcaggccagcgtgaggtgcttggctacgcacggtcgcttcctggaaattggcaaattcgacctttctcagaaccacccgctcggcatggctatcttcctgaagaacgtgacattccacggggtcctactggatgcgttcttcaacgagagcagtgctgactggcgggaggtgtgggcgcttgtgcaggccggcatccgggatggggtggtacggcccctcaagtgcacggtgttccatggggcccaggtggaggacgccttccgctacatggcccaagggaagcacattggcaaagtcgtcgtgcaggtgcttgcggaggagccggaggcagtgctgaagggggccaaacccaagctgatgtcggccatctccaagaccttctgcccggcccacaagagctacatcatcgctggtggtctgggtggcttcggcctggagttggcgcagtggctgatacagcgtggggtgcagaagctcgtgttgacttctcgctccgggatccggacaggctaccaggccaagcaggtccgccggtggaggcgccagggcgtacaggtgcaggtgtccaccagcaacatcagctcactggagggggcccggggcctcattgccgaggcggcgcagcttgggcccgtgggcggcgtcttcaacctggccgtggtcttgagagatggcttgctggagaaccagaccccagagttcttccaggacgtctgcaagcccaagtacagcggcaccctgaacctggacagggtgacccgagaggcgtgccctgagctggactactttgtggtcttctcctctgtgagctgcgggcgtggcaatgcgggacagagcaactacggctttgccaattccgccatggagcgtatctgtgagaaacgccggcacgaaggcctcccaggcctggccgtgcagtggggcgccatcggcgacgtgggcattttggtggagacgatgagcaccaacgacacgatcgtcagtggcacgctgccccagcgcatggcgtcctgcctggaggtgctggacctcttcctgaaccagccccacatggtcctgagcagctttgtgctggctgagaaggctgcggcctatagggacagggacagccagcgggacctggtggaggccgtggcacacatcctgggcatccgcgacttggctgctgtcaacctggacagctcactggcggacctgggcctggactcgctcatgagcgtggaggtgcgccagacgctggagcgtgagctcaacctggtgctgtccgtgcgcgaggtgcggcaactcacgctccggaaactgcaggagctgtcctcaaaggcggatgaggccagcgagctggcatgccccacgcccaaggaggatggtctggcccagcagcagactcagctgaacctgcgctccctgctggtgaacccggagggccccaccctgatgcggctcaactccgtgcagagctcggagcggcccctgttcctggtgcacccaatcgagggctccaccaccgtgttccacagcctggcctcccggctcagcatccccacctatggcctgcagtgcacccgagctgcgccccttgacagcatccacagcctggctgcctactacatcgactgcatcaggcaggtgcagcccgagggcccctaccgcgtggccggctactcctacggggcctgcgtggcctttgaaatgtgctcccagctgcaggcccagcagagcccagcccccacccacaacagcctcttcctgttcgacggctcgcccacctacgtactggcctacacccagagctaccgggcaaagctgaccccaggctgtgaggctgaggctgagacggaggccatatgcttcttcgtgcagcagttcacggacatggagcacaacagggtgctggaggcgctgctgccgctgaagggcctagaggagcgtgtggcagccgccgtggacctgatcatcaagagccaccagggcctggaccgccaggagctgagctttgcggcccggtccttctactacaagctgcgtgccgctgagcagtacacacccaaggccaagtaccatggcaacgtgatgctactgcgcgccaagacgggtggcgcctacggcgaggacctgggcgcggactacaacctctcccaggtatgcgacgggaaagtatccgtccacgtcatcgagggtgaccaccgcacgctgctggagggcagcggcctggagtccatcatcagcatcatccacagctccctggctgagccacgcgtgagcgtgcgggagggctaggcccgtgcccccgcctgccaccggaggtcactccaccatccccaccccaccccaccccacccccgccatgcaacgggattgaagggtcctgccggtgggaccctgtccggcccagtgccactgccccccgaggctgctagatgtaggtgttaggcatgtcccacccacccgccgcctcccacggcacctcggggacaccagagctgccgacttggagactcctggtctgtgaagagccggtggtgcccgtgcccgcaggaactgggctgggcctcgtgcgcccgtggggtctgcgcttggtctttctgtgcttggatttgcatatttattgcattgctggtagagacccccaggcctgtccaccctgccaagactcctcaggcagcgtgtgggtcccgcactctgcccccatttccccgatgtcccctgcgggcgcgggcagccacccaagcctgctggctgcggccccctctcggccaggcattggctcagcccgctgagtggggggtcgtgggccagtccccgaggagctgggcccctgcacaggcacacagggcccggccacacccagcggccccccgcacagccacccgtggggtgctgcccttatgcccggcgccgggcaccaactccatgtttggtgtttgtctgtgtttgtttttcaagaaatgattcaaattgctgcttggattttgaaatttactgtaactgtcagtgtacacgtctggaccccgtttcatttttacaccaatttggtaaaaatgctgctctcagcctcccacaattaaaccgcatgtgatctccaaaaaaaaaaaaaaaaaaaaaaaa

SEQ ID NO: 539 - DNA, 2268 bp, Human
aatatcttgcatgttacagatttcactgctcccaccagcttggagacaacatgtggttcttgacaactctgctcctttgggttccagttgatgggcaagtggacaccacaaaggcagtgatcactttgcagcctccatgggtcagcgtgttccaagaggaaaccgtaaccttgcactgtgaggtgctccatctgcctgggagcagctctacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggctggctactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatctgtcactgtgaaagagctatttccagctccagtgctgaatgcatctgtgacatccccactcctggaggggaatctggtcaccctgagctgtgaaacaaagttgctcttgcagaggcctggtttgcagctttacttctccttctacatgggcagcaagaccctgcgaggcaggaacacatcctctgaataccaaatactaactgctagaagagaagactctgggttatactggtgcgaggctgccacagaggatggaaatgtccttaagcgcagccctgagttggagcttcaagtgcttggcctccagttaccaactcctgtctggtttcatgtccttttctatctggcagtgggaataatgtttttagtgaacactgttctctgggtgacaatacgtaaagaactgaaaagaaagaaaaagtgggatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgcccacttgctccccgtgagcactgcgtacaaacatccaaaagttcaacaacaccagaactgtgtgtctcatggtatgtaactcttaaagcaaataaatgaactgacttcaactgggatacatttggaaatgtggtcatcaaagatgacttgaaatgaggcctactctaaagaattcttgaaaaacttacaagtcaagcctagcctgataatcctattacatagtttgaaaaatagtattttatttctcagaacaaggtaaaaaggtgagtgggtgcatatgtacagaagattaagacagagaaacagacagaaagagacacacacacagccaggagtgggtagatttcagggagacaagagggaatagtatagacaataaggaaggaaatagtacttacaaatgactcctaagggactgtgagactgagagggctcacgcctctgtgttcaggatacttagttcatggcttttctctttgactttactaaaagagaatgtctccatacgcgttctaggcatacaagggggtaactcatgatgagaaatggatgtgttattcttgccctctcttttgaggctctctcataacccctctatttctagagacaacaaaaatgctgccagtcctaggcccctgccctgtaggaaggcagaatgtaactgttctgtttgtttaacgattaagtccaaatctccaagtgcggcactgcaaagagacgcttcaagtggggagaagcggcgataccatagagtccagatcttgcctccagagatttgctttaccttcctgattttctggttactaattagcttcaggatacgctgctctcatacttgggctgtagtttggagacaaaatattttcctgccactgtgtaacatagctgaggtaaaaactgaactatgtaaatgactctactaaaagtttagggaaaaaaaacaggaggagtatgacacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 540 - DNA, 4336 bp, Human
agttcgccctgccggaaagcagcacgccgccgcggcattttacgacgtcggcggtgacaggccctgggactctgggaatacccagcttcctccccgcaacccggtgaaagccaacgcaatgttcggtgcgggggacgaggacgacaccgatttcctctcgccgagcggcggtgccagattggcctcactttttggactggatcaggcagctgctggccatggaaatgaatttttccagtacacagccccaaaacagcctaagaaaggccagggaacggcagcaacaggaaatcaggcaacaccaaaaacagcaccagccaccatgagcactcccacaatactggtcgcaacagcagtccatgcatatcgatacacaaatggtcaatatgtaaagcagggcaaatttggtgctgcagttctggggaaccacacagccagagagtataggattcttctttatatcagtcaacaacagccagttacggttgctaggattcatgtgaactttgagctaatggttcggcccaataactatagcaccttttatgatgaccagagacagaactggtccatcatgtttgagtcggaaaaggctgctgtggagttcaataagcaggtgtgcattgctaagtgcaacagtacctcttccctggatgcagtgctctcccaggacctcattgtggcagacggccctgctgtagaagttggagattctttggaagtggcctataccggctggctctttcagaatcatgtgctgggccaggttttcgactccactgctaacaaagataagttgcttcgcttgaagttaggatcaggaaaagtcatcaagggctgggaggatggaatgctgggcatgaaaaaaggaggaaagcgattgcttattgtccctccagcctgtgctgttggctcagaaggggtaataggctggactcaagcaacggactcgatcctggtgttcgaggtggaggttaggcgggtgaagtttgccagagattctggctctgatggtcacagtgttagttcccgcgattctgcagctccgtctcccatccctggtgctgacaacctctctgctgatcctgttgtgtcaccacccacatcaatacctttcaaatcaggggagccagctcttcgtaccaaatctaactccctcagtgaacaacttgcaataaatacaagtcccgatgcagtcaaagccaagttgatctctcggatggctaaaatgggccagcccatgctgcccatccttccaccacagctggattccaatgattcagaaatcgaagatgtgaacactctgcaaggaggtgggcagcctgtggtgactccgtccgtccagccctctcttcatccggcccatccagcgttaccacagatgacctcacaggcacctcagccatctgttactgggctccaggcaccttctgctgccttaatgcaagtgtcatctctcgattcccactcagctgtatctggaaatgcccaatcctttcagccctatgcaggtatgcaagcctacgcttatccccaggcatctgccgtcacctcccagctgcagcccgttcggcctttgtacccagcaccgctctctcagcctccccatttccaaggatcaggtgatatggcttcatttctcatgactgaagcccggcaacataacactgaaattcgaatggcagtcagcaaagtggctgataaaatggatcatctcatgactaaggttgaagagttacagaaacatagtgctggcaattccatgcttattcctagcatgtcagttacaatggaaacaagcatgattatgagcaacatccagcgaatcattcaggaaaatgaaagattgaagcaagagatccttgaaaagagcaatcggatagaagaacagaatgacaagattagtgaactaattgaacgaaatcagaggtatgttgagcagagtaacctgatgatggagaagaggaacaactcacttcagacagccacagaaaacacacaggcaagagtattgcatgctgaacaagagaaggccaaggtgacagaggagttagcagcggccactgcacaggtctctcatctgcagctgaaaatgactgctcaccaaaaaaaggaaacagagctgcagatgcagctgacagaaagcctgaaggagacagatcttctcaggggccagctcaccaaagtgcaggcaaagctctcagagctccaagaaacctctgagcaagcacagtccaaattcaaaagtgaaaagcagaaccggaaacaactggaactcaaggtgacatccctggaggaggaactgactgaccttcgagttgagaaggagtccttggaaaagaacctctcagaaaggaaaaagaagtcagctcaagagcgttctcaggccgaggaggagatagatgaaattcgcaagtcataccaggaggaattggacaaacttcgacagctcttgaaaaagactcgagtgtccacagaccaagcagctgcagagcagctgtctttagtacaggctgagctacagacccagtgggaagcaaaatgtgaacatttgttggcctccgccaaggatgagcacctgcagcagtaccaggaggtgtgcgcacagagagatgcctaccagcagaagctggtacaacttcaggaaaagtgtttagccctccaggcccaaatcacagctctcaccaagcaaaatgaacagcacatcaaggaactagagaagaacaagtcccagatgtctggggttgaagctgctgcatctgacccctcagagaaggtcaagaagatcatgaaccaggtgttccagtccttacggagagagtttgagctggaggaatcttacaatggcaggaccattctgggaaccatcatgaatacgatcaagatggtgactcttcagctgttaaaccaacaggagcaagagaaggaagagagcagcagtgaagaagaagaagaaaaagcagaagagcggccacgaagaccttcccaggagcagtcagcctcagccagttctgggcagcctcaagcacccctgaatagggagaggccagagtcccccatggtgccctcagagcaggtggtcgaggaagctgtcccgttgcctcctcaggccctcaccacttcccaggatggacacagaaggaaaggggactcagaagctgaggcactctcagagataaaagatggttcccttccacccgaactgtcttgcatcccatcccacagagttctagggcccccgacttcaattccacctgagcccctaggccctgtatccatggactctgagtgtgaggagtcacttgctgccagcccaatggcagctaagcccgacaacccatcaggaaaggtctgtgtcagggaagtagcaccagatggcccactacaagaaagctccacaagactgtccctgacttcagaccccgaggagggggacccactggccttagggcctgaaagcccaggagagcctcagcctccacagctcaagaaagatgatgtcactagctccaccggtccccacaaggagctgtcaagcacagaggcaggttccacagttgcaggagcagccctcagacccagccatcattcccagcgttccagtctctctggggatgaagaggatgaactgtttaaaggggcaactctgaaagctctgaggcccaaagcacagcctgaggaggaggatgaagacgaggtgagcatgaagggacgcccgcccccaacgcccctttttggagatgatgatgatgacgatgacattgactggctgggatgaagacccaggaaactggtgcaaaggtttctctgcaacccttccctaagcatgattttgcacagccaaccctgggtctaggcgaaccacagggtgaggtcaaggtgagcattctgggaacaatatttgggctcagagggtgggttggccaccttctgagccccacccccgccagacctggtgaagaggatcataaccctgtcttcaagaacactgggatttcagcagcaagttggaagaaggactggtaggttcccctccaagccagtcacctgtaagagtcctgtcctctgccagactttttaatctcttcattaactctcagactgacctgggagccctcctctacctgaatccagtgctcaactgtgccccggcaacaagacctgggctgaggtctccctggtagaactaagggagattacaccatctaaatcccagtgcagtcaacagcctggcctatagtcctgggacatgtatcttcttctttgccttaaatctgatacaagaggtcaatgactttgaaaataaaactaaaataaatgtctataatgaaacttg

SEQ ID NO: 541 - DNA, 1787 bp, Human
ggccgaacctggttcccgaggcgcggcggccgcggctgggggcggggaggggggcgcaggaccccaagtgggggtcccggagccagagggccaattcctgtccccccagcagcatggcatcgtgtgctgaaccctctgagccctctgccccactgcccgccggggtcccaccgctcgaggacttcgaggtactggatggggttgaggatgcagagggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgccccagccccggccccagaagagtggctggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagacggccatggtcactgctgactccaagtactgctacggcccccaaggcagcaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgaggccatccccatcctgagggcagccctgaagctggaaccttccaacaagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccccaggctccctgtccactgccctccctggtctggccccctcctccgggttaggggagcaaggattgggggtcgtgcagcccagccagcaggagggactgaggccctctaggaggaaagcccagagggagggggccctcattccttcagacccagttttcccccaccctccttaccccgctgggctaggtctccgccagggctggcctcagtttctcctcaacaggcctgggggcagcccttcccctgcctagtccccgcctgagtgccagccccccaccccgcctgccgccccctgtccaggttccctccccgccacagtgaaataaagcatcccaccctgcagtttcaaaaaaaaaaaaaaaaaaaaa

SEQ ID NO: 542 - DNA, 3175 bp, Human
tttccttttccggctacgggtccccaagcggagcgggaggccggaccggggagccgagcggcggcgtcggcggcgtcggcggcggcggcgacggcggcgggggcggtaatggcggagctggtgcaggggcagagcgctcctgtggggatgaaggccgagggcttcgtggatgccctgcaccgggtccggcagattgctgctaaaattgattcaattcctcacttgaataattccacacctctagtggacccctcagtatatggatacggagtacaaaaacggcccttggatgatggagtaggtaaccagttaggggccttggtacatcaaaggacggtaataacggaagaattcaaagtgcctgacaaaatggttggatttattatcggcaggggaggtgagcagatttcacggattcaagcagaatctggttgcaaaattcagattgcttcagagagttctgggattccagagaggccctgtgtacttaccggaaccccagaaagtattgaacaagccaaacggctcctgggacagattgtggaccgctgtcgaaatggacctggctttcataatgacatagacagcaacagcacaatccaggagattctcattcccgcatctaaagtgggtctggtcatcggcagaggaggggaaacaatcaagcagttgcaggagcggacaggggtgaagatggtcatgatccaggatggcccattgcccacgggagcagacaagcctcttcgtatcactggagatgcatttaaagtacagcaagcaagagaaatggtactagagattatccgagaaaaagaccaagctgactttcggggtgtacgcggcgatttcaactctcgaatgggaggaggcagtatagaggtatctgtgcctaggtttgctgtggggattgtaataggaagaaacggggaaatgatcaaaaagatccagaatgatgctggtgtgaggattcagtttaaaccagatgatgggattagtccagaaagagctgcccaggtcatgggccctccggatcggtgtcagcatgcagcgcatatcatcagcgagctgattcttacagcccaggaaagagacggctttggaggcctggcagcagccagaggaagaggtcgtggccgtggcgactggagcgtgggagcccctggtggcgtccaggagataacatacacggtgccagccgataagtgtggcctcgtcataggcaaagggggtgagaacatcaaaagcatcaaccagcagtcaggggcgcacgtggagcttcagaggaacccccctcccaacagcgaccccaacctgcggagattcaccatcaggggggttccccagcagatcgaggtggccaggcagctcatagatgagaaagttggcgggaccaatctcggagcacctggagccttcggacagagtccattcagccagccacctgccccacctcatcaaaatacctttcctccaaggagctccgggtgcttcccaaacatggctgccaaggtgaatgggaacccccacagcacccctgtgagtggtcctccggcctttctgacccagggctggggcagcacctaccaggcgtggcagcagcccacacagcaggtcccaagccagcagagccagccgcagagcagccagcccaactacagcaaggcctgggaagactattacaaaaaacagagtcacgccgccagcgctgctcctcaggccagctccccaccggactacacaatggcctgggcagaatattacagacagcaggtcgctttctacggacagacgttagggcaggcgcaggcccacagccaggagcagtaggacagcgtcctcgtggccaactctcccctcaaaatcattgtcaaagaaaacctatttgtaacagaggtttttacatttgcaaaccttttgatgaagaactgttgttttgttctgtgaaacactatatttagattaacggaatttttctaaaaatcaggaaaattagttactaaaaattgctgatcatttttgtttcattatttttgttatttcaaatgtataagctctgggattctttttggagcaatacctacaaagtcaggcaccagaatgtgcctcagagctgtgacatttcaacatgatggttttggtttggtttggttttgtgtcctttttatttgcagttttttctgttgcaacagaaagtggcttggaagtcttaggtggtatgtaacaaattctttttaaaaattttaaagcagtatttaagtattcttaaatgtgtaaattcatttaatgttttacttctaatttcttgtatcttggctgtctggttttattgcatttttaaaaaaactgaactattatgtattgtaatgaatgatgtgaattctgaactgagacagataattgtattgctgtccaacaggggttgggaggggcattttgtagggtttgtataatttctagagttcgaaaggggtaatataaaaatgtgctcgtgtgtttagcctacgtttttctcatgcctccattaccagttgcaattgtgtatctaagacctccaagcttgtttttaaaacaaaacaaaaaacctttctctattatctcagaaatataaatactgttatttttaatattaagaaattcaatataacttttaacacacactgtggaacattaaaccgtataaaaatgtagttataactatttttaattccaaggtgttgtttgcttttttcttttaaatattttcttaatattttgtcagattaactagatgaataaataaatctagtattaaccgcattatgaattaaataattttgatttaatgaaagggataatatgatttccagtgtttactgtagtgtatcttgtacagataacatgtatttttaaaggaaaaaaaacggaattgaagctattttttcttgcatttctaattgacctgagggacattccgtttgaaatgtactgaagttacagtttctggttttttctccttatttttcttataatgcttgaaatgtctaactattaaaaaagacaattggaaaatgttatgcatggggtttttaagaaaacaaagtgttctttttatttgactgacaattcattttacactctatataataaaatctccacaaggcatcttgtgggcaaagtcaaaaaaaaaaaaaaaaaa

SEQ ID NO: 543 - DNA, 2861 bp, Human
gagaggttacttccggggcggcaccgagaagctgaaacggaagtggcgtacggcatgcgccggtggcgtgatggagcggcagcagcagcagcaacagcaactgcgaaacctgcgtgacttcctgttggtctacaatcggatgacagaactctgcttccagcgctgtgtgcccagcttgcaccaccgagctctggacgctgaggaggaggcctgtctgcacagctgtgctgggaagctgatccattccaaccaccgcctcatggccgcttacgtgcagctcatgcctgccctggtacagcgccgcatcgcagactacgaggctgcctcggctgtgccaggcgttgctgctgaacagcctggggtctctccatcaggcagctagccatacccaaccccaggaaggaaggccttggatggaccctcagattgaaggacccggtggaccttggggttggtgaatcctaaacagagagaattcgaggttgcctgaaagctgggtgtccttgctccttttcctggagccaatatacccagtttttactcagtttgatttatattctgggcaaggaagctttgcctactttattggcacaatccgttgttctgtcgtttagtgcatatctgctggcttcagccctggcagctgagaaattgttttctatatgtagaaggaaaacctgagcatttgcaggcatctggttaaagcagggtctgtgtgtacaattttaaaacgggtaatatgtcatgctcttagttcatcttcacaacaaaactatgagtaagcggtattagcctcacttaacagatgaggaagcaagattccagaaagtaccagaaggtcattttatacaacaggagattggttcctgcccagatgacagaaaatgggagctctgtctagttgtccttaagtctgactgacttcagtggctcataaccgtgagccaagtatttgttggttcataactgttgttttgtgaactatgtcttacatgtctagagttctgctggatctagggaaaggaggagctatcgaagtacaacggatcaaaaaaccacagggcttttgggcactgcctccttgggaagttagtggccacagaagagagatgaaacctgtaagaagtctggagtcttttggaacttcagccatttccccaggttgttactttcttagtatgtacagtcttctcaggatgagcagtaaaacctttgaacaaaggtctgtgtggttgtcttcacgggcaatcaggaagggagagagctggggaccatattctgcaatgcagccaaatccgaggaagagaaactgaagggagaagtagatggcaatggttatgataaaaagggataaaactaaatcttcgggacttctttaatgctacgttaatgtttcactgctcgtctagaaactcctaaatccagctttctatcatctgccccacattggtcccattgagtacattctgtgatttctaattccagcctctccattcttttctcattattgcctcccccgccccccaactttgtgtaatttacttctgtattcagcagcctggatagcatatcattccatcaccccattttcttgccaccattggccatctttttgtatcattccacttattctgtcttttccattccttcattcaaactgctagagaaaaacagttgtgtaatgaatgccactaaatattcaaggcctccaacctcagccaagtcctcacaccaacacgcagtcacaccaacacacacctttatgggttcctggtccatttccttctctaattaccatggcagttattttacacctctactgctgtccttaatcccataccccaccctcatcaggtgaccctgtttccttttttagagaaattgaagctcttagacattggtttccacagtaataattttaaaacttcttacaactacctacaaagcagatgttctatcctatctacagagcagaaaattgaaattctcaagtagcagacccggtattaaagtgcagatctgactttaaagtccatgttcattttacacagcaggctgcctcttaagatagtatttattgagcacacactttgtgtaggttctgattttggtagatgtcatgctttatattaatctttacaacaactataagtaagaggtattaacctcacttaacagatgaggaagcaagaatccagaatgtgccagaaggcacattctgcagatttcgtgcaaacatttatacacagcttcttttttttttttttgagacagagtctcgctctgtcacccaggctggagtgcagtggagcgatctaggctcactgcaacctccgccacccgggttcaagcagttctcctgcctcagcctctcgagtagctgggattacaggcatgcgccaccacgcccagctaattttgtttttgtattttaagtagagacggggtttcactgtattggtcaggctggtcttgaactcctgaccttgtgatccgcccgcctcggcctccaaaagtgctgggattacaggtgtgagccaccacggccggcctatacaaagtttcttattgagaaaagtggttccaatcatgttttttgccccctttagctgctatctcttgaacagaaaagtttgttaggaaggtaaaagttgctgactaggaccttacccacagggtggcactctgtccttgggaaatataaatgcaagtaaaacaggtttgaacttcttaacttccagaagataggaggatgggacctgtgatactgtgctgctggtgggaggacccttccacatcaacatttgtgtgtatccttgcaataaacttccattgtgaattaaaaaaaaaaaaaaaaaaaa

SEQ ID NO: 544 - DNA, 1485 bp, Human
ccgggagggttgggccagaggaggcggtcctggtagggagtgcgtagcagggtggagtcgctgtccggtcgcgcttcacttctgctccgccctccctgctccccataacagacccctccctccactaaggcttccaaacgtcgccccaagcctcccaatttctcgcagcccttcatgctcttctcttggccctagcaggagtggtcaccagcagtccctgtcccttggcaccaggagtccctgtagcctggctaggtaaggaaagggagttgcatctccaaataaggaagatccagttgtggccacccaattcctcctcttcgaaagacactttctgcccatcacctgctttctgtgccaggaccatctttactttctccacaaaagcccatcctctattcctatttccgaagctcctgctcatggagagttcgaattgctctggccttgaaaggcatcgactacgagacggtgcccatcaatctcataaaggatgggggccaacagttttctaaggacttccaggcactgaatcctatgaagcaggtgccaaccctgaagattgatggaatcaccattcaccagtcactggccatcattgagtatctagaggagatgcgtcccactccgcgacttctgcctcaggacccaaagaagagggccagcgtgcgtatgatttctgacctcatcgctggtggcatccagcccctgcagaacctgtctgtcctgaagcaagtgggagaggagatgcagctgacctgggcccagaacgccatcacttgtggctttaacgccctggagcagatcctacagagcacagcgggcatatactgtgtaggagacgaggtgaccatggctgatctgtgcttggtgcctcaggtggcaaatgctgaaagattcaaggtggatctcaccccctaccctaccatcagctccatcaacaagaggctgctggtcttggaggccttccaggtgtctcacccctgccggcagccagatacacccactgagctgagggcctagctcccaaatcctgccccgttggcacagggccacaggagcagaagctgggtgggctgaagaggcctggaaacgagagtcttaattgaggagatgggagactcgaactctagccctggatctgccttcctgctgaaacttgttccacctcagtcccctcatctgtcacacgcatgtggggtggagtagggagatgcggggagcagggtgggcaggaatactgttatctatgtgacggggcagtcgtgaggctgagatgagaatgcggattaaaatgcctggcgtgctcaccgtaacaccacggggaaggctgtgtgccttttctcatccgcttttgttgtgtgtgactccaaagaatgcccgcgctgaaatttggcgtgaattaaactgaagcccaggcctctaaaaaaaaaaaaaaaaaaaaaaaaaaaaaaaaaaaaaaaaaaaaaaaaaaaaaaaaaaaaa

SEQ ID NO: 545 - DNA, 1429 bp, Human
aagacaagcgggcattggccacagcagcgcgaggcgggcacggggtattgtccggctccggcggcggcggtcggtgctgcgagagcggcggcggcggcgcgggtcggcagcgggagggcgcgcggccgagcggaggcggagtcggcgccgagaacatggctggaggcaaagctggaaaggacagtgggaaggccaaggctaaggcagtatctcgctcacagagagctgggctacagtttcctgtgggccgcatccacagacacttgaagactcgcaccacaagccatggaagggtgggtgccactgctgccgtgtacagtgctgcgattctggagtacctcactgcagaggtgctggagctggcaggtaatgcttctaaggatctcaaagtaaagcgtatcactccgcgtcacttgcagcttgcaatccgtggtgatgaagagttggattctcttatcaaggctaccatagctgggggtggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcatagacaattactgtagacatgataaaagaaacatttgtatgttcttagactcgaagtttgataaaagtaccttttcatgtggtgacagttgtgtgttgattggctaggtttctcccgtgtgttttatacaaaaatggaattgataaaccattttttacaaaattaatttgtctcaaaactgttctgttcatgatgtattagaaatattttactcagactttaaatattttaaatctcagattggttattcagagtaaccttagaacagaaattgggaatatatctttacaatgattgataccatggtatattgactcttagatgctattgatctgtagcaccattttttacaaacgactaaggaaaaaacctgccaattaaatcatgatatgccatcaattatgagacatcccaatttgagagatgttagattatagaaaagtatgcatttatgactgaaatggtagtggaattatttgaattctacaccaagcacttaccatgtgccaggccctttgcagagtgctctactgaccaagaaagttgttgctgccacattatagatgtggagcctaagggtcacagaaattgtgtgctatgccaaaaaacattgaactggtagatagaaaatgacagagctaggattcaaacctagatctggctgactccagagcctagttttacctggaattgatgttcagtttatcaaaggtttctccttttggtttaaaatcccaatttttggcctggcattgtggtttacgcctgtaatcccaacac

SEQ ID NO: 546 - DNA, 1785 bp, Human
gagagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaaaaaaaaaaaaaaaaaa

SEQ ID NO: 547 - DNA, 2797 bp, Human
ggattcgatcctgcgcgacggccgcgaaggcgggggcggaggctcggcctgcgcggctgggagcggcttaggggaggagggaagaccggaagccacggttgcgtccccatccttagattcgctcctccgggcagggagcggagacggaggaggaggagggagaggctgaatgttggctcgggagacgtacgaggaggaccgggagtacgagagccaggccaagcgtctcaagaccgaggagggggagatcgactactcggccgaggaaggcgagaaccgccgggaagcgacgccccggggcgggggcgatggcggcggcggcggccggagcttctctcagccggaggcaggtggaagtcatcataaagtttctgtttcacccgtcgtccatgttcgaggactctgtgaatctgtggtggaagcagacctcgtggaagcgctggaaaaatttgggacaatatgctatgtgatgatgatgccatttaaacgacaggctctagtggaatttgaaaacatagatagtgccaaagaatgtgtgacatttgctgcagatgaacccgtgtacattgctggtcaacaggcttttttcaactattctacaagcaaaaggatcactcggccaggaaatactgatgatccatcaggaggcaacaaagttcttctgctctcaattcagaatccgctttatccaattacagtggatgttttatatactgtatgcaaccctgttggcaaagtgcaacgtattgttatattcaagagaaatgggatacaagcaatggttgagtttgaatcagtcctttgtgcccagaaagctaaagcagcactcaatggagctgatatatatgctggatgttgcacactaaaaattgaatatgcacggccaactcgtctaaatgttattaggaatgacaatgacagttgggactacactaaaccatatttgggaagacgagatagaggaaagggtcgccagagacaagccattttgggagaacacccttcttcgtttagacatgatggctatggatcccatggtccattattgcctttaccaagtcgttacagaatgggctctcgagatacacctgaacttgttgcttatccattaccacaggcttcttcctcttacatgcatggaggaaatccctctggttcagttgtaatggttagtggattacatcaactaaaaatgaattgttcaagagtcttcaacctgttctgcttatatggaaatattgagaaggtaaaatttatgaagaccattcctggtacagcactggtagaaatgggtgatgagtatgctgtagaaagagctgtcacacaccttaataatgtcaaattatttgggaaaagacttaatgtttgcgtgtctaaacaacattcagttgttccaagtcaaatatttgagctggaggatggtaccagcagctacaaagattttgcaatgagcaaaaataatcgctttacaagtgctggccaagcatctaagaatataatccagccaccctcctgtgttttgcattattataatgttccattgtgtgtcacagaagagaccttcacaaagttgtgtaatgaccatgaagttcttacattcatcaaatataaagtgtttgatgcaaaaccttcagccaaaacactttctgggctattagaatgggagtgcaaaactgatgcagtagaagcccttacggcactgaatcactatcagataagagtgccgaatggttccaatccctatacattgaagctttgcttttctacatcatcccatttataagaagagaagagcatgttagaatttatgttcacctttattacaatttcaaagctacacttcattaaaaaaaaatctaaaatggttgatctcatgttgccttgcttactttaagatcctgttctgtaataaacatattttgccttgagtaaatttgttgtaagcttaaatattgaattgttttcattttaagatagaatatcataatgtagactatctacagcttcattgtagattatacagatatatgatttctaaccttattactggaatttttcttccacagtaaaaatatatttgcattcttaatgctaattatctgcaagtattttttcattgtgtaagagattaatgcaggtgaaagtattgcattttaatatagaattcctattatatgtttagatgtttaagtatgttgcagttactcatattaaacataacttgtatatttattattttaatgaagtttgagaataacgttacatatgttgaattttaagtactacagatttaactgattttatatttctgaaaggctaacagacatggatacacgtgtacagtatgcattcaaacttatttaaattggtgtatttttttttaagtcactgtccatttgtattgacatgcctctgtttctagtccagtttggagattttataaagttataacaatgagttaatgtgttcattttcatttgttgcatgtgacttaaatacagctagtatttggcattgagattttaatagaggttataattaacagttcctcttatagataataatctgggatccatgggtgggcttcagagaatctgtgtaccccctaaaattgtatgtagaattttggatatttacatttttattttttaactcttggatccatcagtaatatgtatttttctatatggtacaagatttaaggatctaattttatttttattccaaacagatagctatttgtctcaataccatttattaaacattctttctcccactgaaaaaaaaaaaaaaaaaa

SEQ ID NO: 548 - DNA, 766 bp, Human
gctccggccccgcctccgccctggaacgcagcgcgctccgcccgaggcctcccggcggcccatacgggaatcgcggagcttagctgtcgccacctcgcgccgggtccgcgcggcccacgggaccccccactgacgcccccggccagcggtccacatggacgtgcggggccctgaagcccccggcgggcgcgcgctgcgggacgcggcagaaaatctatttcaggaacttcaggaacattttcaagctctgacggcaacattaaacctcagaatggaagaaatgggaaatcgcattgaggacttacagaagaatgtcaaggacttaatggtgcaagctggcattgaaaattctattaaagaacaaatgctgaagacctaactgcagcatgtctgtatttggagatggggcctctacagaagtcattaaggttacatcggtcctgagggtggggccctcatccaacaggattcgtctttctgagaagagacgcaaggggctcgcctgctctcccctccgtgcctgcaccagagaaggaggccatcggcaagccaaggagagccctccccagaaatcacacggaccagcaccttgatctgggacttccagaaaacagaactgtgaaaagacaagtttctgttgtttaaaccacccaatctgaagtattttgttatggcagtcctgggcagactaatacaatatgcaacacatttacaataaatatacaataaacttacaaatgtggaatgtaaaaaaaaaaaaaaaaaa

SEQ ID NO: 549 - DNA, 2473 bp, Human
atcgtgaggcggagcgcggtggggtgggtgcggaagggggcgaggcccgaggagtggagccgggcttgtgattgggtcttgtaagggcagccgggcgtctattggccggggaagccgtaatggcaggcagcaggggcgggccccttctggaaggttctaagatagggtataagaggcagggtggcgggcggaaaccggtctcattgaactcgcctgcagctcttgggttttttgtggcttccttcgttattggagccaggcctacaccccagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaattggcaccataaaaaaaaaaaaaa

SEQ ID NO: 550 - DNA, 3464 bp, Human
ggtagttactatggaaacccagctgccatcgctatgtctctgcaaaagacccctccgacccgagtgttcgtggaactggttccctgggctgaccggagccgggagaacaacctggcctcagggagagagacgctaccgggcttacgccaccccctctcctcaacacaagcccaaactgctacccgcgaggtgcaagtaagcggcacctcagaagtgtctgcgggccctgaccgggcgcaggtggtggtgcgagtgagcagcaccaaggaggcggcagccgaggccaaaaagagcgtttgtcgccgtctagattacatcacgcagagcctccagcagcagggcgtgcaggcagaaaatataactgtgacaaaggattttaggagagtggaaaatgcttatcacatggaagcagaggtctgcattacatttactgaatttggaaaaatgcaaaatatttgtaactttcttgttgaaaagctagatagctctgttgtcatcagcccaccccagttctatcatactccaggttctgttgagaatcttcgacggcaagcctgtcttgttgctgttgagaatgcgtggcgcaaagctcaagaagtctgtaaccttgttggccaaaccttaggaaaacctttactaatcaaagaagaagaaacaaaagaatgggaaggccaaatagatgatcaccagtcatccagactctcaagttcattaactgtacaacaaaaaatcaaaagtgcaacaatacatgctgcttcaaaagtatttataacttttgaggtaaagggaaaagagaagagaaaaaagcacctttgaaattccaaacaaattatattgtacttgtatctttttacctatttttatactttttataatgtttacgtttgtcctgaatatatatatatatatatatatatatatatatatggtataggagataagctatttctttccaaaatctataaatctttgaatatagtcccacagaatacttatgttcactttctatttttaaaagactactctgaaaaacactcttggataataaatgtattatgtgcatacttatatactgacagttcatacaagcacatgtgtaatatttctattataaggacagatattgacccttgcatttcataatttttaaagatatttaagctaaaattttctcagccacatttttatataaaaccaaattttatgtaaaaactaggcttcaataagttagctaaattttttaaattgtaagacaaaatttttatggaaaagaattcctatatcccatcaaacctaataattttccacaactaaaaatgagtataaatacataattttaagtgcatcctgtcaggtctgatatttaattttactttagttagaagctaagtagttaccctgttacttcttcatggatgctaacagaagacttgagattcccagacagaaacaaaggactattactcatggcacaacaaggagcatgagcatcagcacattctcattgcttccccttgtcccaggtcccatgggggcaaaatgatatggccatatgcaatatggctacatatacagcaggcttttgttgtaggtaaagaatactgagcttggagggttcactgctttttatccatgaacagaagcaaacctgctctttgcctcatcccttatagatgctcactcaaaactcaatactgagaaatggcccaggtaaagaacagccaaggtctttcatgcttgccacacccagcaatatgtttaggaaggtgaagtctactgagggctatctcacatctaacagtttctttactaggaccagagaccattttggtaagatgcagataacaaccccaaccttaacaacttcacaacatgaatagaaatagtgataaataattcatagctttttacaaaagaataatgaggtataataggaaaatgttttgatgccaaaaataaaagagttaatgtttggatcggactccaacagggctccttagagtgatacaaatacaaagcaaacgatatgtgtaatttaaaatttcctagtgcacatgtttttttatttttctttttcgagatggagtctttctctgtcgcccaagctggagtgcagtggtacgatctcagctcactgcaacctctgcctcctgaatttaagcgattctcctgcctcagcctcccaagtagctgggattacaggcgtgagccactgcatctggccctgtacgcacatttttaaaaataaaactttaaaaaagaaacagttgaaactaattttaataacattttatttaaccaaatatatcaaaaatattatttcagcatgtaatcagtattttttaaattgagatatttgttttatcttcaaaattcagtgtatatttttacataatagcacatctcaattcacatgctaaattttcatcagaaatattttatctgtatttaaatttcctaaaatgtacagttgaaaaaaagagattcacatacccaggttgttctagcatgcctaaaaaatcttgtaactggatcaagtatcagtttttaaattagttaaaattaaataaaatttaaaatttagttcctcagtcacactagccatatttcaagtacttgaaggccacaaatggcttgagactaccttgctgaacagaccaaggtcaaacactgagataataatgattcttaaggccatttgaaagttaacagcaagtatgtattactgctatctacagtaagaattacattttatctacaggcaatcataagccatgtctgttatgcagcataggctttccattctctatacatctaggtcatagagtttttccattgataaatctggatgtttatataccaacagtactttcttacaacatattccagtatatagtgtccagcttcacccactttttaaagtggccctgaaacaattttattcatcttattggagtgttgctgtaggggaagagtagaagctaagaagagtttgagttcaacaccattatatccaaatcctgaccttactactggaatgtaagctccttgaaagtggagatcttgtctgtcttgttcacagttgtgttcccagccccagaggtagtctcagggccaatatcaagtatgctctcaaatatttgctgggaaaatttactagctggataaaaggcaagttactttaatctctttaatcttcctttgtccttacaaatgaaagagactaatagtacttaaccttgcagtgttattataaggattaaagttgataaatatatgatcatgagaacaattgctagcacataacggtcactctgaaaatagtagctgatatatcagctgcattgtttgattattgttggctcaattaaaagttggcttttccaaatcctccattaggaagaatttttaaatagccatattgaaaataaagttgtcagaaaaccaaaaaaaaaaaaaaaaaa

SEQ ID NO: 551 - DNA, 2197 bp, Human
aaattaacgtactatcctccttacttttgggtcgggccctccgggaagatggcggccgtgcaggcggccgaggtgaaagtggatggcagcgagccgaaactgagcaagaagtggtggtaatcattagttccagggtgctctgccatgttgacgcaagctgctgtaaggcttgttagggggtccctgcgcaaaacctcctgggcagagtggggtcacagggaactgcgactgggtcaacttgctcctttcacagcgcctcacaaggacaagtcattttctgatcaaagaagtgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatcaatactacaaaatccgcagtcaagcaattcatcagctgaaggtcaatggggaagacccatacccacacaagttccatgtagacatctcactcactgacttcatccaaaaatatagtcacctgcagcctggggatcacctgactgacatcaccttaaaggtggcaggtaggatccatgccaaaagagcttctgggggaaagctcatcttctatgatcttcgaggagagggggtgaagttgcaagtcatggccaattccagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggaaacaaggtatcgccagagatacttggacttgatcctgaatgactttgtgaggcagaaatttatcatccgctctaagatcatcacatatataagaagtttcttagatgagctgggattcctagagattgaaactcccatgatgaacatcatcccagggggagccgtggccaagcctttcatcacttatcacaacgagctggacatgaacttatatatgagaattgctccagaactctatcataagatgcttgtggttggtggcatcgaccgggtttatgaaattggacgccagttccggaatgaggggattgatttgacgcacaatcctgagttcaccacctgtgagttctacatggcctatgcagactatcacgatctcatggaaatcacggagaagatggtttcagggatggtgaagcatattacaggcagttacaaggtcacctaccacccagatggcccagagggccaagcctacgatgttgacttcaccccacccttccggcgaatcaacatggtagaagagcttgagaaagccctggggatgaagctgccagaaacgaacctctttgaaactgaagaaactcgcaaaattcttgatgatatctgtgtggcaaaagctgttgaatgccctccacctcggaccacagccaggctccttgacaagcttgttggggagttcctggaagtgacttgcatcaatcctacattcatctgtgatcacccacagataatgagccctttggctaaatggcaccgctctaaagagggtctgactgagcgctttgagctgtttgtcatgaagaaagagatatgcaatgcgtatactgagctgaatgatcccatgcggcagcggcagctttttgaagaacaggccaaggccaaggctgcaggtgatgatgaggccatgttcatagatgaaaacttctgtactgccctggaatatgggctgccccccacagctggctggggcatgggcattgatcgagtcgccatgtttctcacggactccaacaacatcaaggaagtacttctgtttcctgccatgaaacccgaagacaagaaggagaatgtagcaaccactgatacactggaaagcacaacagttggcacttctgtctagaaaataataattgcaagttgtataactcaggcgtctttgcatttctgcgaaagatcaaggtctgcaagggaattcttgtgtgctgctttccatttgacaccgcagttctgttcagccatcagaagagagacaaggaattaaaaatttctttttaatcctgttaccaaataaaaaa

SEQ ID NO: 552 - DNA, 3800 bp, Human
gcatactgctagtggcgcgcggaggagcgacgcgtggagaagcggcccacgtgtctgcccagagtcaagtcctgtgttcttcccgctccttacgcatccgcggtccagggcgccctttcagccccgctggtgttcgcccaccccgggccgcgtgagtggggccccacgcagctccccgcactccgtgggccaacttggccaagcaactctgtccggggagcggtgcttgcggggggtgagtaccgggcactgcgcatgcggagctccaaattcaaacagctgttttcagaggctggagggcgggcggactggtagcagctggggctaggagaggctttctctaggaggcggccgctcgggagccatggtggaccggggccctctgctcacctcggccatcatcttctacctggccatcggggcggcgatcttcgaagtgctggaggagccacactggaaggaggccaagaaaaactactacacacagaagctgcatctgctcaaggagttcccgtgcctgggtcaggagggcctggacaagatcctagaggtggtatctgatgctgcaggacagggtgtggccatcacagggaaccagaccttcaacaactggaactggcccaatgcaatgatttttgcagcgaccgtcattaccaccattggatatggcaatgtggctcccaagacccccgccggtcgcctcttctgtgttttctatggtctcttcggggtgccgctctgcctgacgtggatcagtgccctgggcaagttcttcgggggacgtgccaagagactagggcagttccttaccaagagaggtgtgagtctgcggaaggcgcagatcacgtgcacagtcatcttcatcgtgtggggcgtcctagtccacctggtgatcccacccttcgtattcatggtgactgaggggtggaactacatcgagggcctctactactccttcatcaccatctccaccatcggcttcggtgactttgtggccggtgtgaaccccagcgccaactaccacgccctgtaccgctacttcgtggagctctggatctacttggggctggcctggctgtccctttttgtcaactggaaggtgagcatgtttgtggaagtccacaaagccattaagaagcggcggcggcgacggaaggagtcctttgagagctccccacactcccggaaggccctgcaggtgaaggggagcacagcctccaaggacgtcaacatcttcagctttctttccaagaaggaagagacctacaacgacctcatcaagcagatcgggaagaaggccatgaagacaagcgggggtggggagacgggcccgggcccagggctggggcctcaaggcggtgggctcccagcactgcccccttccctggtgcccctggtagtctactccaagaaccgggtgcccaccttggaagaggtgtcacagacactgaggagcaaaggccacgtatcaaggtccccagatgaggaggctgtggcacgggcccctgaagacagctcccctgcccccgaggtgttcatgaaccagctggaccgcatcagcgaggaatgcgagccatgggacgcccaggactaccacccactcatcttccaggacgccagcatcaccttcgtgaacacggaggctggcctctcagacgaggagacctccaagtcctcgctagaggacaacttggcaggggaggagagcccccagcagggggctgaagccaaggcgcccctgaacatgggcgagttcccctcctcctccgagtccaccttcaccagcactgagtctgagctctctgtgccttacgaacagctgatgaatgagtacaacaaggctaacagccccaagggcacatgaggcagggccggctccccaccccacctttgatggcctcttcccccctcaccctagggtgtcccgagatgaccgggacgcctggcccctggtgggggggcagcctcggaactgggagtggggggccaggggccttcctaaccttccatcatcctcagctagatgtatgcccgggacagggcctctgttctccagctgaaccataccctggctgtgggggcatctgtcctgagcttggctggtgtatctcacaatgcaaagacatgctggctggcgggacaggtgggcaggactgaccctgaggaggccttgcctgcagggtctttgtctcaccatttggtggagtatcacacggttctctgaggtctggggcctcagctgtttaagtttaccggtattactgagctcggcatttggagagggagctctgaagtgtctggggaggtaccgctgtgcgtggggtcaggtgtttccgtaccacagcaggagcagggcccgcccgcatcccagctgtgggcctgccggtcaggtcgggcacctactacaaaccgtagtggggtggaggctgctggaggtgggagtgaggagatgagggcagggtctcaaacagtcctgactcacagggcctggaaacaagtcctatgtgggcctggggcctggggtcctcatcctccttgttggtctactcaggcccagcccagagctgtgttccctgtctcaggtcaagcagtggcagacgcaaggctttctgtgggcccccaagtggtaggagggagagtagcagagcatgggttactggaagccgggactgctagggctggtggccagggagctgcaagagtgaggctcagctctggctggttctgcccttacccctcctgcccgcctgagaactgcacaccctgcccgctggccccaggacctgcactcccaatcctgctgtcttctccttccctgtgccctgaacaaggacctcactgcccgccttcccctcccaccagcccccttgggccaggcagggtgaggccaaattgctcttggcccacaaatgggtgatggtcagatatgtgaatcaagctcctttctctagctagtgtttgatgtgcacgtgtgtgtgcacagtgcgtgtgtgcacacgcacacctgtgcactcgtgtgtgtttaagaaaggaaaggatttgggctggggagcaaaagataatgtgaaactgttggtggactctctggtgaggggtgggcagaacttgctgctactagagttcttgggttctccatgatgttcaccctggggctggcccactgtgtcctgaatgtttttgttattttttgttttattttttaaacaaactgctgtttttatatacctggaatctgttgttggcttcagagccagtggttaaagagcagggtcccaaggattgggagatctagtgtctgccctcctgccctgcaactcaattgggcctttttcggtgacctcatccaaggccatgatgtcaagggccatgtccccaagcagaggtggagaaggggacactgaggtgagcaaaagcaggaaggggcatccactgcgggtgactggaggccgggcaggaagcaagtcatcagagccgctcagctccgttcactctctgccttctgccccactactgtggggcagtggggccagagcccacctccccaacatgtgaagacagtgatgggcacgtgcccacacccccacttctctagccgtttgcagaggccgccacccagcaggggcctgaaaaggagcagcctcgtatttttctgtgaaatgttttaatgaaccatgttgttgctggttgtcctggcatcgcgcacactgtatgtacatactggcaacgatgtcaaatgtaatttattttaacatttttacaataaaacatgaggtggacaggccaaaaaaaaaaaaaaaaaa

SEQ ID NO: 553 - DNA, 2654 bp, Human
ggatccccggaggcggtccccgggttgcagtgagggaagtgggccgggaggagagatgggcggtgaagaggcccggccctgccagggaggcgggcggatccgtggcagtgaccagaaggggccggaagggggtggccgccggccgggccccgccctggggccgcctccccgcgggttccgttggctgtggcggcagctgacgcttgtggcggcggtggcttcggggtgggcgtaagatggcgacagcagcgcagggacccctaagcttgctgtggggctggctgtggagcgagcgcttctggctacccgagaacgtgagctgggctgatctggaggggccggccgacggctacggttacccccgcggccggcacatcctctcggtgttcccgctggcggcgggcatcttcttcgtgaggctgctcttcgagcgatttattgccaaaccctgtgcactctgtattggcatcgaggacagtggtccttatcaggcccaacccaatgccatccttgaaaaggtgttcatatctattaccaagtatcctgataagaaaaggctggagggcctgtcaaagcagctggattggaatgtccgaaaaatccaatgctggtttcgccatcggaggaatcaggacaagcccccaacgcttactaaattctgtgaaagcatgtggagattcacattttatttatgtatattctgctatggaattagatttctctggtcgtcaccttggttctgggacatccgacagtgctggcataactatccatttcagcctctttcaagtgggctttatcactattatatcatggaattggccttctattggtcccttatgttttctcagtttacagacattaaaagaaaggacttcctgatcatgtttgtgcatcacttggtcaccattgggcttatctccttctcctacatcaacaatatggttcgagtgggaactctgatcatgtgtctacatgatgtctcagacttcttgctggaggcagccaaactggccaattatgccaagtatcagcggctctgtgacaccctttttgtgatcttcagtgctgtttttatggttacacgactaggaatctatccattctggattctgaacacgaccctctttgagagttgggagataatcgggccttatgcttcatggtggctcctcaatggcctgctgctgaccctacagcttctgcatgtcatctggtcctacctaattgcacggattgctttgaaagccttgatcaggggaaaggtatcgaaggatgatcgcagtgatgtggagagcagctcagaggaagaagatgtgaccacctgcacaaaaagtccctgtgacagtagctccagcaatggtgccaatcgggtgaatggtcacatgggaggcagctactgggctgaagagtaaggtggttgctatagggacttcagcacacatggacttgtagggccactggcaacatactcctcttggcccttcccatatctactcttctgtgattgggagactgcaaggcactgaggagtatcaaagaagcaaatattttcactttgaaagaaaactgccattttgtatttaatagcctccaggttctttcagtaatgttatttgctctgtgtgtttttgtgtgtttgttgatgtgcgtttgtgcatatgcgtgagtttcattgccggggttggggcacaattgtggactggggccatgaggccttccctggtccccactgaacccaccttagttccacatttggctgcatcttgaattatgccaactccagacttctccttcttttttgcccttggctcttgacactctaaacccctggaccatctgaatggagcagccaagttcagtcccacatttctgtactgttcctctttcacagctggaatatgtcacatgatgaagttgtatagaaacagaaccatggatggatggccaggattgccgtggtccctagctagatccccttcctatcaatcacctgatagcaacagggacagctgccaataccctgctctttactcaatggtacccagggagggagcatgggaagagggtgagctgagggctggaggagggcaacagccactgggtgagctgttcacggtcttatactattgtttgtttgtgattaaaagtgcttcaacccacctctactgtctcaacctcttcagtgactctatccgcagtttcctgaatccataagctaattaagagcttttccaggtctgattcagaaggccctggacaccaaatttttcctttctgtgcatggtaggaagagtcagccagggtgcttacattttagagctttatgttttttaagaaaaagaagaatcacttgaacctgggaggcagaggttgcagcgagccaagatcgtgccactgcactccagcctgggcgacagaccgagactctgtctaaaaaaaaaaaaaaaaaaaaaaattaggtcatacttttagttcctcaacttgctatattgaatagactaatattgttgtgaaatatgaatgaatatgcttttgaaagtcagatgagaaatgtattttgccttctgaaatttgaacaattgccttgttaatacaaactggattggttggtgtagctaatctgacaaaagatgcaattggataaaacaata

SEQ ID NO: 554 - DNA, 3829 bp, Human
cttcttgtaagagagtgctaggcacatagcctcctcctattcctaatcctcccaccaaagaaagaggcacagagttcattacttagtgggggccagctgtgatcggccaactgccagctgccttaaaaaggaagaccagtgatgctaggatggagtgaaacccaagaggaagtgccatcatgaggaatcaatgagagatctgtgaagagagagggctgggtgggagcccagaaggatagaacctggaagatcaatatctcccgtgagggaaataacaatggagccaggttctaagtcagtgtctaggtcagactggcaacctgaaccacaccagaggcctataaccccgctagagcctgggccagaaaagacacccatagcccagccagaatcgaagactctgcagggatccaatacccaacagaagcctgcttcaaaccaaagacccctcacccagcaggagacccctgcacaacatgatgctgaatcccagaaggaacctagagcccaacaaaaatctgcttcacaagaggaatttcttgccccacagaagcccgcaccacagcaatcaccttacatccaaagggtgctgctcactcaacaggaagctgcctcccagcagggacctgggctaggaaaagaatctataactcaacaggagccagcattgagacaaagacatgtagcccagccagggcctgggccaggagagccacctccagctcaacaagaagctgaatcaacacctgcggcccaggctaaacctggagccaaaagggagccatctgccccgactgaatctacgtcccaagagacacctgaacagtcagacaagcaaacaacgccagtccagggagccaaatccaagcagggatctttgacagagctgggatttctaacaaaacttcaggaactatccatacagcgatcagccctagagtggaaggcactttctgagtgggtcacagattctgagtcagaatcagatgtgggatcatcttcagacacagattctccagccacgatgggtggaatggtggcccagggagtgaagctaggcttcaaaggaaaatctggttataaagtgatgtcaggatacagtgggacgtcgccacatgagaaaaccagtgctcggaatcacagacactaccaggatacagcctcaaggctcatccacaacatggacctgcgcacaatgacacagtcgctggtgactctggcggaggacaacatagccttcttctcgagccagggtcctggggaaacggcccagcggctgtcaggcgtttttgccggtgtacgggagcaggcgctggggctggagccggccctgggccgcctgctgggtgtggcgcacctctttgacctggacccagagacaccggccaacgggtaccgcagcctagtgcacacagcccgctgctgcctggcgcacctcctgcacaaatcccgctatgtggcctccaaccgccgcagcatcttcttccgcaccagccacaacctggccgagctggaggcctacctggctgccctcacccagctccgcgctctggtctactacgcccagcgcctgctggttaccaatcggccgggggtactcttctttgagggcgacgaggggctcaccgccgacttcctccgggagtatgtcacgctgcataagggatgcttctatggccgctgcctgggcttccagttcacgcctgccatccggccattcctgcagaccatctccattgggctggtgtccttcggggagcactacaaacgcaacgagacaggcctcagtgtggccgccagctctctcttcaccagcggccgctttgccatcgaccccgagctgcgtggggctgagtttgagcggatcacacagaacctggacgtgcacttctggaaagccttctggaacatcaccgagatggaagtgctatcgtctctggccaacatggcatcggccaccgtgagggtaagccgcctgctcagcctgccacccgaagcctttgagatgccactgactgccgaccccacgctcacggtcaccatctcacccccactggcccacacaggccctgggcccgtcctcgtcaggctcatctcctatgacctgcgtgaaggacaggacagtgaggagctcagcagcctgataaagtccaacggccaacggagcctggagctgtggccgcgcccccagcaggcaccccgctcgcggtccctgatagtgcacttccacggcggtggctttgtggcccagacctccagatcccacgagccctacctcaagagctgggcccaggagctgggcgcccccatcatctccatcgactactccctggcccctgaggcccccttcccccgtgcgctggaggagtgcttcttcgcctactgctgggccatcaagcactgcgccctccttggctcaacaggggaacgaatctgccttgcgggggacagtgcaggcgggaacctctgcttcaccgtggctcttcgggcagcagcctacggggtgcgggtgccagatggcatcatggcagcctacccggccacaatgctgcagcctgccgcctctccctcccgcctgctgagcctcatggaccccttgctgcccctcagtgtgctctccaagtgtgtcagcgcctatgctggtgcaaagacggaggaccactccaactcagaccagaaagccctcggcatgatggggctggtgcggcgggacacagccctgctcctccgagacttccgcctgggtgcctcctcatggctcaactccttcctggagttaagtgggcgcaagtcccagaagatgtcggagcccatagcagagccgatgcgccgcagtgtgtctgaagcagcactggcccagccccagggcccactgggcacggattccctcaagaacctgaccctgagggacttgagcctgaggggaaactccgagacgtcgtcggacacccccgagatgtcgctgtcagctgagacacttagcccctccacaccctccgatgtcaacttcttattaccacctgaggatgcaggggaagaggctgaggccaaaaatgagctgagccccatggacagaggcctgggcgtccgtgccgccttccccgagggtttccacccccgacgctccagccagggtgccacacagatgcccctctactcctcacccatagtcaagaaccccttcatgtcgccgctgctggcacccgacagcatgctcaagagcctgccacctgtgcacatcgtggcgtgcgcgctggaccccatgctggacgactcggtcatgctcgcgcggcgactgcgcaacctgggccagccggtgacgctgcgcgtggtggaggacctgccgcacggcttcctgaccctagcggcgctgtgccgcgagacgcgccaggccgcagagctgtgcgtggagcgcatccgcctcgtcctcactcctcccgccggagccgggccgagcggggagacgggggctgcgggggtagacgggggctgcggggggcgacactaaaagcctgttgttcccatctgcgccggcctccgtcatgaatgccttccgggccgggcggaaggggacgcgggctgtgccttacttaagtcgggggtggcaagggggcggggcgggggcccgaaagctgagaccctcgccacggggagggggacgcgcacacacaccggtcaccgagacggctggacctgcacgccaccgctgccttttgctgctgctgctgcggcgaccgccgcagggacggggactggccctcccttgcaggtcggtttggtttgttgtaaataaaagtatttaattagtttggcaaaaaaaaaaaaaaaa

SEQ ID NO: 555-556 - skipped (2 entries)

SEQ ID NO: 557 - DNA, 3772 bp, Human
gccgccgccgccgccgccgccgcgccgcggcttgagggcgggaggctgggggagggtagcggagccggcgccgccgccatgttgggtctgaagcggctgctgtaggcgccgacggagcgagcgggcgtgcggagcgggcgacagtggcgtgggatctgcctctctgcgagcagctgggagcggcggcggcggcgccatgagcgggggcaccccttacatcggcagcaagatcagcctcatctccaaggcggagatccgctacgagggcatcctctacaccatcgacaccgaaaactccaccgtagcccttgccaaagttcgatcctttggtacagaagacagaccgacagatcgtccaataccacctcgagatgaagtctttgaatacattatattccgtgggagtgacattaaagaccttactgtttgtgagccaccaaaaccacagtgttctttgcctcaagacccagctattgttcagtcctcactaggctcatcgacttcttcattccagtccatgggttcttatggacctttcggcaggatgcccacatacagtcagttcagtccgagttccttagttgggcagcagtttggtgctgttggtgttgctggaagctctttgacatcctttggaacagaaacatcaaacagtggtaccttaccccaaagtagtgcggttggttctgcctttacacaggatacaagatctctaaaaacacagttatctcaaggtcgctcaagccctcagttagaccctttgagaaaaagcccaaccatggaacaagcagtgcagaccgcctcagcccacttacctgctccagcagctgttgggagaaggagtcctgtatcaaccaggcctttgccatctgccagccaaaaggcaggagagaatcaggagcacaggcgagctgaagtacacaaagtttcaaggccagaaaatgagcaactcagaaatgataacaagagacaagtagctccaggtgctccttcagctccaaggagagggcgtgggggtcatcggggtggcaggggaagatttggtattcggcgagatgggccaatgaaatttgagaaagactttgactttgaaagtgcaaatgcacaattcaacaaggaagagattgacagagagtttcataataaacttaaattaaaagaagataaacttgagaaacaggagaagcctgtaaatggtgaagataaaggagactcaggagttgatacccaaaacagtgaaggaaatgccgatgaagaagatccacttggacctaattgctattatgacaaaactaaatccttctttgataatatttcttgtgatgacaatagagaacggagaccaacctgggctgaagaaagaagattaaatgctgaaacatttggaatcccacttcgtccaaaccgtggccgtgggggatacagaggcagaggaggtcttggtttccgtggtggcagagggcgtggtggtggcagaggtggtaccttcactgcccctcgaggatttcgcggtggattcagaggaggtcgtgggggccgggagtttgcggattttgaatataggaaaaccacagcttttggaccctaaaaggtctggattgatcgtactgctttctgaaagaaagacaacaaagttgctgcatagtctacaaacaagtctctgaaaataggtgaatttctagctcttcatggtcctgaacattgatttcagtctttgcaaagaatgaagaagtgaattcgctgtacatttgtcaccagcactgggtttttgttttttgtttgtttttccgcttaatttcaaagataaaatgcagttacttttgggggtggaaggctcatcttaaaacatgagcattaaatatatttggaatagcagaaggttaagtaatttcttatgtatagttaaactaaagcagtacttcagtgggacttaacaagtattttttcatcactgaaaggttttttttttttatcactaaattgtatttggcaattgcaagttgcctgcagatagggccgtgatactgtgttttgagccacagaaggttgtgtgtgtgtgtgtgtgtgtgtgtgtgtgtgtgtgtgtatgtgtgtgtctttttcctcctttcttttggggaatcctgtaatatgaggtagcttatttcgtcaattaattagggtgctggatggtagagaattttgtcagtcaactatgtacacacagtaaatactgtttcttaggcaaaggtaacttttttatatagttgtaaaattccattatattccattgccaaagaaacattaagaactttgtatagctgtataaaaagcaactaattttttaaagaataaacattttaaagtcagcaaacatactgtgtccttgcagaagttgatgtgctgagcagcagccttatgggtgggtctttttttcttagttttccaggcttaacatttttgattttgttttttaatgtttggaacataaatgaagatttgatacattatttcattatctaaaaaggattaattattcatgctcattgtaagaacttcattttgtagcaaatggcatatcacaggatctgtccagataatcgatattttcagtatacaaatgtaaataatcacagatgagaatgtacttagctgtattttcaaataagtaatcttccccccttttgtaggactttaaaactaggcatcaatgaacctgtttttcctattatgcctggaatttagtcatgataccttgactcattccatcatatttcaagaggattcagagtgctagaaattattttggtagcctgtaacacacggcaacactggtccttgggcctatgatgacccacagatgactcagtatagagttcattgctaattataaattactagtgaatctttttgatattttaagctctagtgggaaaaatctggccacttttgtgtttttatgaaggccatggaataaaaggatccaaagatttaaatatttttatctaatattttgattgttttcttaactttctccttaaaacattcagtagtgataaagatatagaaactgcactgtaggagaattggaatatttaaggctggttgacattttttattttcattttatatcttttgtatagctctacaaggcagtgttttgtaatttggtttcattatgaagatccagtacttggcagccatagtttagacaatattgttcagtgctgtttgcttgcatgttaacaacaaaaccttttagaggacccacaaatcatgatattgaacacagttccgaggcattcagagcatcagagcaagtaccatggcaatacatgtgtagactgttggagatgtcccgggccaatttcaagaaagaaaactgtaaatactagttctacttgctctgaaattatgagtttatgcgttttcccagccctccgaatcactgactggggcgttttgtgccccagcaataactggcagcatggcatacctgcagtaccccttacaatattaaagcaaagtttttattctaaaacagaataaaactgttcaataaaaaatgctcgtcaaagttctttctctttaaatagtaacattctgtttcagtaggaacataatgaaaggaatcttttaaatggaagagcggaattataatgtttgtattccctgtaataactataaatcagttactttatttctaagattgagttattgttgcagatgtttagggaaagctaaaagccccttccttcccctcctgtgtgtaaataaaatacttctgagatca

SEQ ID NO: 558 - DNA, 2618 bp, Human
cctctcagagccccagtcgcgcgccccttcttggttcgctcggtgcccgcgcaggcccctcgggcggtggcgaggaggcgcccaggcggaggcggcggcgggcggaggagcgcaggagcgggcggccaggccaccgcgcggcggcggagcgggccgcggcccggcgctccttccccaccgcggcccgacgcaccccggccgccgccatgagcggctcctcaggcaccccgtatctgggcagcaagatcagcctcatctccaaggcgcagatccgctacgagggcattctctacaccatcgacaccgacaactccaccgtggcgctcgccaaagtgaggtcctttggcactgaagaccgtcccacagataggcctgcgccccccagagaggagatttatgagtacatcattttccgaggaagtgacatcaaggatatcactgtgtgtgaacctccgaaagctcagcacacactcccgcaggatcccgccattgttcagtcttccctgggttctgcctccgcctcgcccttccagccgcacgtgccttacagccctttccgagggatggcgccctacggcccgctggcggccagctccctgctcagccagcagtatgccgcctccctgggtctaggagctggttttccatccatcccagtcggcaagagccccatggtggagcaggctgtgcagactggttctgctgacaacctgaatgctaaaaagctgttacctggcaagggcaccacagggacgcagctcaacggtcgtcaggcccagccgagcagcaagacggccagcgatgtagtccagccggcagctgtgcaagctcaagggcaggtgaatgacgagaacagaagacctcagaggaggcgatcaggaaacaggcgaacaaggaatcgctccagagggcaaaaccgtccaactaacgttaaggaaaacacaatcaaatttgagggtgactttgatttcgagagtgcaaatgcccagttcaaccgagaggagcttgacaaagaatttaagaagaaactgaattttaaagatgacaaggctgagaagggggaagagaaggacctggctgtggtgacccagagtgccgaagcgcccgctgaggaagaccttctggggcccaactgctactatgacaaatccaagtcgttcttcgacaacatctcttctgaactcaagaccagctccaggcggacgacgtgggccgaagagaggaagctcaacacagagacctttggggtgtcagggaggtttcttcgtggccgcagttctcggggcggattccgaggaggcaggggcaatgggaccacccgtcgcaaccccacttcccacagggccgggactggcagggtgtgagggtgcagccaaaggctcctactgaagtggcgcataactgacgctgtgtgtgtcaggacgcgaggaaaacgctgcacttacagggagaggtggtcactttgtttacggagtttggaagagacccatactgctacttgtgttttggacttaactgaacttggacatggtctgagttagaaccacttgttttggggaagtattcatgggtaacctctttgaggtctctttatctgtgtttcctttttagttgcgcatagcctaattctaaggttttggtattttgcaaaaaggtttctatagtgaaagctgaatccttactttgtgacttttttttttttttttaatgacaagctttgacttttaaaagtggaaccaaatctgttggcagaggtggcagccaagtacatctctgtaacccagctggcccctggtgctgttggcctggcaccccactgccaagggtggggtctcaggagtcaggcagggccagcacagggtggcgtggggggcaggggtgggtgggtggagggcacggaaggggttttcccatggatcatgttgtataagtgaaccagaccaccctgatggcatccacagtgatgtcaaggttggggctggccaggggtgggtggactagaagcatttgggagtagtggccaggggccctggacgctagccacggagctgctgcacagagcctggtgtccacaagcttccaggttggggttggagcctgggatgagccccggcagcgccttggcccttctgtggtccctgccagcctctgacctgggccggtcagtcattgctggactctggccacacactggcgttctcatccacttggaaacaagccagtcttttctgcaaggtcagttgaccaagagcatatttcccctctgttgtacatcgttgttttgtgtttgtgttgtaacagtgggtggagggagggtggggtctacatttgttgcatgagtcgatgggtcagaactttagtatacgcatgcgtcctctgagtgacagggcattttgtcgaaaataagcaccttggtaactaaacccctctaatagctataaaggctttagttctgtattgattaagttactgtaaaagcttgggtttatttttgtaggacttaatggctaagaattagaacatagcaagggggctcctctgttggagtaatgtaaattgtaattataaataaacatgcaaacctttaaaattttaaaaaaaaaaaaaaaaaaaaaaaa

SEQ ID NO: 559 - DNA, 2235 bp, Human
tcagcccacttccggggagggaggcagaggaacccctccccgccgctcacccctaagcccagccctcggctcccacccttgtgtacctgggccgaaccattcaccggagcgcgcagcgggtggagtgtggctcggaggaccgcggcgggtcaagcacctttctcccccatatctgaaagcatgccctttgtccacgtcgtttacgctcattaaaacttccagaatgcaacaggacggacttggagtagggacaaggaacggaagtgggaaggggaggagcgtgcacccctcctggccttggtgcgcgccgcgccccctaaggtactttggaagggacgcgcgggccagacgcgcccagacggccgcgatggcgctgttggccggcgggctctccagagggctgggctcccacccggccgccgcaggccgggacgcggtcgtcttcgtgtggcttctgcttagcacctggtgcacagctcctgccagggccatccaggtgaccgtgtccaacccctaccacgtggtgatcctcttccagcctgtgaccctgccctgtacctaccagatgacctcgacccccacgcaacccatcgtcatctggaagtacaagtctttctgccgggaccgcatcgccgatgccttctccccggccagcgtcgacaaccagctcaatgcccagctggcagccgggaacccaggctacaacccctacgttgagtgccaggacagcgtgcgcaccgtcagggtcgtggccaccaagcagggcaacgctgtgaccctgggagattactaccagggccggaggattaccatcaccggaaatgctgacctgacctttgaccagacggcgtggggggacagtggtgtgtattactgctccgtggtctcagcccaggacctccaggggaacaatgaggcctacgcagagctcatcgtccttgactggctcttcgtggttgtggtatgcctggctgccttcctcatcttcctcctcctgggcatctgctggtgccagtgctgcccgcacacttgctgctgctacgtcaggtgcccctgctgcccagacaagtgctgctgccccgaggccctgtatgccgccggcaaagcagccacctcaggtgttcccagcatttatgcccccagcacctatgcccacctgtctcccgccaagaccccacccccaccagctatgattcccatgggccctgcctacaacgggtaccctggaggataccctggagacgttgacaggagtagctcagctggtggccaaggctcctatgtacccctgcttcgggacacggacagcagtgtggcctctgaagtccgcagtggctacaggattcaggccagccagcaggacgactccatgcgggtcctgtactacatggagaaggagctggccaacttcgacccttctcgacctggcccccccagtggccgtgtggagcgggccatgagtgaagtcacctccctccacgaggacgactggcgatctcggccttcccggggccctgccctcaccccgatccgggatgaggagtggggtggccactccccccggagtcccaggggatgggaccaggagcccgccagggagcaggcaggcgggggctggcgggccaggcggccccgggcccgctccgtggacgccctggacgacctcaccccgccgagcaccgccgagtcagggagcaggtctcccacgagtaatggtgggagaagccgggcctacatgcccccgcggagccgcagccgggacgacctctatgaccaagacgactcgagggacttcccacgctcccgggacccccactacgacgacttcaggtctcgggagcgccctcctgccgaccccaggtcccaccaccaccgtacccgggaccctcgggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaagaacttggccctgagtcgggaaagtttagtcgtctgatctgacgttttctacgtagcttttgtatttttttttttaatttgaaggaacactgatgaagccctgccatacccctcccgagtctaataaaacgtataatcacaaaaaaaaaaaaaaaa

SEQ ID NO: 560 - DNA, 2747 bp, Human
caaacccttgttctgggttagaggtcctggtaccttcagttaacagtcgggtttcgtttgattttgttacggcgcccctgggccttcgattaataaggttcggtcaacggacaagtgagcggttccactgctcgtcagtcgatagggggagtcggtagtctgtccgaccgtaccattaggcgcctgggccggaggaggggttttcagggtcgtaggacgccgttgggcaccacgctcggagaaggacaggacaatggcggccttagggtccccgtcgcacacttttcgaggacttctgcgggagttgcgctacctgagcgcggccaccggccgaccctatcgcgacaccgcggcctatcggtaccttgtgaaggctttccgtgcacatcgggtcaccagtgaaaagttgtgcagagcccaacatgagcttcatttccaagctgccacctatctctgcctcctgcgtagcatccggaaacatgtggccctacatcaggaatttcatggcaagggagatacaactcgtcaacgaatcaaattcagtgatgacagagtatgcaagagtcaccttctcaactgttgtcctcatgatgtcctttctggaactagaatggatcttggagaatgtctgaaagtccatgacctggctttaagagcggattatgaaattgcatccaaagaacaagattttttctttgaacttgatgccatggatcatctgcagtcattcattgcagattgtgatcgtagaacagaagtggccaagaaaagattagcagaaactcaagaagagattagtgctgaagtagcagcaaaggcagaacgtgttcatgagttaaatgaagaaattggtaaattgttagccaaggtggaacaactaggagctgaagggaatgtggaggaatcccagaaagtaatggatgaagtagagaaagcacgggcaaagaaaagagaagcagaggaagtttatcggaattctatgccagcttccagttttcagcagcagaaacttcgagtctgtgaagtctgctctgcctatttaggacttcatgataatgacagacgactggctgatcattttgggggtaaactgcacctgggatttattgaaataagagagaagcttgaagaattaaagagagtcgtagctgagaagcaggagaaaagaaaccaggaacggctgaaacgaagagaagagagagagagagaagaaagggagaagctgaggaggtcccgatcacacagcaagaatccaaaaagatccaggtccagagagcatcgcagacatcgatctcgctccatgtcacgtgaacgcaagaggagaactcgatccaaatctcgggagaaacgccatcgccacaggtcccgctccagcagccgtagccgcagccgtagccaccagagaagtcggcacagttctagagataggagcagagaacgatccaagaggagatcctcaaaagaaagattcagagaccaagacttagcatcatgtgacagagacaggagttcaagagacagatcacctcgtgacagagatcggaaagataagaagcggtcctatgagagtgctaatggcagatcagaagacaggaggagctctgaagagcgcgaagcaggggagatctaactagctgtgtacatttcttcagtccttaagcttcctacggagttacgtactattgtttagttcacagctgttcagggtgacagtgagcagatccagacaccagatccagctaggctagatgtacagtatctaacttgatctgaactgaacctgttttccttgatgatgcctaaaactacatccatagtttctggtgaacctgtaatacagttctgaaagtacagttttatataataagatgctgatctctttattctttcaagtaagagtgctagtgaacaaattgtgttacttgccttgggattttttgaacgtttgtaaaatgctgtcttcctagtccaaacagctgcagctttgggcatttttctttttaattattcttcctctgactttgtatcccttaatacctacactctccaattgtaagagaaagggggcagggaagcaatatagcttccattctaaggctgtattcccgttatgaattactagctgattacagttcagagcattgatcctggaatgtgtgctggagaaatttaaaatactggggttttttgtttaatggtgcctatttagagttggaagttgaacagctgttgcattacatacttttgcttttttattgaaattttgaaatcaaacgtcttgatttttctgttctgttgaattgctatgttcaggatgttctagggggtgggggcagggactcttttcgtaataagcacttgttttattttgtgtgtgtggagtataaaggctacacccttattgtaaaaaaataataataataaaatgaaagaaacaatcaccaccaccattattaaactgtaacttgtctagtaaattgtcactagaactatttgctgtgggcatttcctctattctgttacgtcattaacagtgccttactgtgcaaggcaccaaaggacataaatacgtacttgcaaagattccagatgagctgttcatgtgggccccttgctgactatattccagccacttcagggttgtttgtaatgaccgttatagagaagggctcgacctgcagaagaaactggggtgtttttattctcattcaacaaacccaaataaaaacagtatatgtaaccaacat

SEQ ID NO: 561 - DNA, 5330 bp, Human
ggcggagccaggccggcctagagtcacttctccccgcccctgactgggccgggagcccggggctggtctctaagagtgggtaccgagaacagcctgaccgtggagaagggctgcgggaagcagaacaccgcccccagcgcccagcgtgctccagaaacatgagcacaaacgcctcagcctccttccccggcggcaccggcaccggcaccagtacccgcaccagtaccggcaccggcaccagtacccgcaccagtaccggcaccggcaccagtacccgcaccagtaccggcaccggcaccgagcgcaaggcggagggcccgcccgaagccgggggcacaactgcccaggtcccgaacccggactccagcttggacgacacctcctacagcctgtccgaatggagcgtccgttctgagtggcggtccgtctcggatccgctagccagttcccagtggagcacgtcctcaactgccgaggccgcctcctggagctccagcatacactccccaatcagcactaccggtcttagcgagagtactgactccgactccaagagtggcctccggggtttcagcgcttacaacccgagcagtcggatccccaagtctaccaccagctcgaactcctccgatggggccgtcacagcctccaatcaggacaccggcattccctgggtattagtaacaggacctaccccgcccgtaaactcccccgtagagtcattgcaagggtctgccttctcctcagggttcagcaccccacggggtttggtaaaaggaccgaccctgcccccggattccaacctgacctcagtgtccgactacacttggatatttgtacggggacctcctatacccaatgacctttcgcaagtgtcaatacaagcacctcctacacccagtaacacccccgagtgtcagtacaagggtctgccgcatcctcagtgtccagcttcccctggggtttggtaccaggaccacctctacccaataacatttccccagtgtcgccacaagcacctcctgcaccccataacatccccccagtgtcaaggcaggcgtctacccccacctcagtgcctgacactccgcggggttcaatacaagaacctcctgcacccagtaatcctttccagctgccgacacaaggacattctaaacctaataactctcgccgagtgtcagtacaagggtccgccccgctctcagtgcccagctccccccgggtatcagctgaaacatcagctccgcccctgggcgctcccggagtatcagcaaaagggttcgccccgcccacagtgcccggctccccccgggtatcaaaagaaggatcggctccgcccccgggctccccgggggagttgatagaagggtccttcccaccctttgccgtccccactcctgtgcctacgacccaggagcgtgtcagccaaagcatggagaatcaagagaaggcgagtatcgcgggccacatgttcgacgtagtcgtgatcggaggtggcatttcaggactatctgctgccaaactcttgactgaatatggcgttagtgttttggttttagaagctcgggacagggttggaggaagaacatatactataaggaatgagcatgttgattacgtagatgttggtggagcttatgtgggaccaacccaaaacagaatcttacgcttgtctaaggagctgggcatagagacttacaaagtgaatgtcagtgagcgtctcgttcaatatgtcaaggggaaaacatatccatttcggggcgcctttccaccagtatggaatcccattgcatatttggattacaataatctgtggaggacaatagataacatggggaaggagattccaactgatgcaccctgggaggctcaacatgctgacaaatgggacaaaatgaccatgaaagagctcattgacaaaatctgctggacaaagactgctaggcggtttgcttatctttttgtgaatatcaatgtgacctctgagcctcacgaagtgtctgccctgtggttcttgtggtatgtgaagcagtgcgggggcaccactcggatattctctgtcaccaatggtggccaggaacggaagtttgtaggtggatctggtcaagtgagcgaacggataatggacctcctcggagaccaagtgaagctgaaccatcctgtcactcacgttgaccagtcaagtgacaacatcatcatagagacgctgaaccatgaacattatgagtgcaaatacgtaattaatgcgatccctccgaccttgactgccaagattcacttcagaccagagcttccagcagagagaaaccagttaattcagcggcttccaatgggagctgtcattaagtgcatgatgtattacaaggaggccttctggaagaagaaggattactgtggctgcatgatcattgaagatgaagatgctccaatttcaataaccttggatgacaccaagccagatgggtcactgcctgccatcatgggcttcattcttgcccggaaagctgatcgacttgctaagctacataaggaaataaggaagaagaaaatctgtgagctctatgccaaagtgctgggatcccaagaagctttacatccagtgcattatgaagagaagaactggtgtgaggagcagtactctgggggctgctacacggcctacttccctcctgggatcatgactcaatatggaagggtgattcgtcaacccgtgggcaggattttctttgcgggcacagagactgccacaaagtggagcggctacatggaaggggcagttgaggctggagaacgagcagctagggaggtcttaaatggtctcgggaaggtgaccgagaaagatatctgggtacaagaacctgaatcaaaggacgttccagcggtagaaatcacccacaccttctgggaaaggaacctgccctctgtttctggcctgctgaagatcattggattttccacatcagtaactgccctggggtttgtgctgtacaaatacaagctcctgccacggtcttgaagttctgttcttatgctctctgctcactggttttcaataccaccaagaggaaaatattgacaagtttaaaggctgtgtcattgggccatgtttaagtgtactggatttaactacctttggcttaattccaatcattgttaaagtaaaaacaattcaaagaatcacctaattaatttcagtaagatcaagctccatcttatttgtcagtgtagatcaactcatgttaattgatagaataaagccttgtgatcactttctgaaattcacaaagttaaacgtgatgtgctcatcagaaacaatttctgtgtcctgtttttattcccttcaatgcaaaatacatgatgatttcagaaacaaagcatttgactttctgtctgtggaggtggagtaggtgaaggcccagcctgtaactgtcctttttcttcccttaggcaatggtgaactgtcattacagagcctagaggctcacagcctcctggaggaagcagcctccactttggatcaggaaatagtaaaggaaagcagtgttgggggtagcggcatgcagaccctcagaccagaatggggacatcttgtggtctgctgcctcaggaatctcctgaccacttgtagtccctccgacttctctagacatctagtctcagtgctagcttatttgtatttttcctctttcacttcttatggaggagagtgtttaactgagttagaatgttgaaactgacttgctgtgacttatgtgcagctttccagttgagcagaggaaaatagtggcaggactgtcccccaggaggactccctgcttagctctgtgggagaccaactacgactggcatcttctcttccccctggaaggcagctagacaccaatggatccttgtcagttgtaacattctatttcaacttcaggaaagcagcagttttcttttaatttttcctatgaccataaaattagacatacctctcaacttacatatgtcttcaacatggttacctctgcataaatattagcaaagcatgccaatttctcttaagtactgaaatacatatgataaatttgactgttatttgttgagactatcaaacagaaaagaaattagggctctaatttccttaaagcaagctcacttgctttagttgttaagttttataaaagacatgaaattgagtcattttatatatgaaaactaagttctctatcttaggagtaatgtcggcccacaagggtgcccacctcttgttttccccttttaaaaactcagatttttaaaagccctttccaaaggtttcaactgtaaaatacttctttttacaatgtatcaacatatttttatttaaggggaattaacaattgccagggaaaccagccaacccaagtttattatatcattaaccttatcataaattcaaacctaagttgctggaccctggtgtgaggacataaatcttccaaagttttgcctatcctaagagctgcatttttctactgctctttaccttgcattttagctaatttaggagttttgagaatgtattggatacgctccagtacataaggagttgccgcatattatatcagactgctttgagaaatctcatccctagtctattgcagttgtttctattagcttactgattaactcagtcctgacacaccttttgggaaatgctgatttaaacttcttaactggcaacagttggaacagtaatcagtttgctaacatatttaaagtcttgaatgttgaagaactcatgtgatttacccttttcaactttttggaaaacgatttaatttattctaattagattaaccctattaatctatggattgggtatcaaaatgaatgccagtccagatgtgcctagacacgaaattggagctgaggactctcacgatatgcaagttcatccaacgtgaagataccataagctttttctctgaaccagagaaatgaaagtcagtttaagaggctgatagatcttggccctgttaaggcatccacttcacagttctgaaggctgagtcagccccactccacagttaggccaagaattagattttaaaacttcatctgtctgtcccagttaactgttaaataaggcctcatcctccactgaagagtatggattgaaggattgtgaactatgtttagtgtgattgtgaacttggtgcctaatgttccatgtctgaagtttgccccagtgctacacgttggagtatacctatgtgtgtgctttgccactgaagtaagattttgcctgtatggtactgttttgtttgttaataaagtgcactgccacccccaatgcagac

SEQ ID NO: 562 - DNA, 3395 bp, Human
ggagtccgggcgaggtgcgcggggcggacgccgcagggcgtgtcacgaggtgagcggggcgggccgagcgccggcgcggggcgcggcgaggctcccgcaccccccgccgcagtcgcgggcctctcccggagaagatggcggatcgcgcggagatgttttctctctccaccttccactcgctgtcgccgccgggctgcaggcctccccaggacataagcctggaagaatttgacgacgaagatctgtctgagatcactgatgactgtggcctgggcctcagctacgactcagaccactgtgagaaggacagcctctccctggggcgctcggagcagccgcaccccatctgctccttccaggatgacttccaggagtttgagatgatcgatgacaatgaagaggaggacgatgaggacgaggaagaggaggaggaggaggaggagggagatggggaaggccaggagggaggagaccctggctcagaggcacctgcccccgggccccttatcccctccccttccgtggaggagccccacaagcaccggcccaccaccctccgtctgaccacactgggggcccaggactccctaaacaacaacggaggctttgacctggtgcgtccggcctcctggcaggagacagcgctatgctcacccgccccggaggccctcagagagctcccgggccccctccctgccacggacaccgggcccggcggggcgcagtcgccagtgcgcccgggttgcgactgcgaagggaaccggcctgcggaaccccctgcgccaggggggacttcgccctcctcagatcccggcatcgaggctgacctgagaagccgctcgagcggcggccgcgggggacgtcgcagcagccaggagctgtcctcgcccggctccgactcggaggacgcgggcggcgcgcgcctggggcgcatgatctcgtccatctcggagacggagctggagctgagcagcgatggcggaagcagcagcagcggccgctcctcgcacctcaccaactccatcgaggaggcctcgtcgcccgcctcggagccggagcccccgcgcgaacccccgcgccgccccgccttcctgcccgtgggccccgacgacaccaacagcgagtacgagtcggggtcggagtcggagccggacctcagcgaggacgcggactcgccctggctgctcagcaacctggtgagccgcatgatctccgagggctcctcgcccatccgctgccccggccagtgcctgtctcctgcgccgcgcccgcccggggagcccgtgtcgccggccggcggggccgcccaggactcccaggaccccgaggcggccgcggggcccggcggcgtggagctggtggacatggagacgctgtgcgcgccgccgccgcccgcgcccgccgcgcctcgacccggccccgcgcagcccgggccctgcctattcctcagcaaccccacgcgtgacaccatcacgccgctgtgggccgcgcccggccgcgccgcccgcccgggacgagcctgctccgccgcctgctccgaggaggaggacgaagaggacgacgaggaagaggaggatgccgaggacagtgcggggtcccccgggggcaggggcacgggcccctcggcgccgcgggacgcgtcgctggtgtacgacgcggtcaagtacacgctggtggtggatgagcacacgcagctggagctggtgagcctgcggcgctgtgctgggctgggccacgacagcgaagaggacagcggcggggaggccagcgaggaggaggcgggcgcggcgctgctaggcggcggtcaggtctcgggggacacctcgccggacagccctgacctcactttctccaagaagttcctcaatgtcttcgtcaacagcacatctcggtcctccagcaccgagtcctttggccttttctcctgtctggtcaacggcgaggagcgagagcagactcaccgggctgtgttcaggttcatcccgcggcatccagacgagctggagctggatgtggatgaccctgtgttggtggaggccgaggaggacgacttctggttccgtggcttcaacatgcgcacgggggagcgcggtgtgtttcctgccttctacgcccatgcggtgcccggccctgccaaggacctgctggggagtaagcggagcccctgctgggtggagcgctttgacgtgcagttcctgggctccgtggaggtgccctgccaccagggcaacggcatcctgtgtgcagccatgcagaagattgccactgcccggaaactgaccgtccacctgcgccctcctgcctcctgtgacctcgagatctctcttcggggggtcaagctgagtctgagcggaggagggcccgagttccagcgctgcagccatttcttccagatgaagaacatctccttctgcggctgccatccccgcaacagctgctatttcggcttcatcaccaaacaccccctgctgagccgcttcgcctgccacgtctttgtctcccaggagtccatgaggccggtggcgcagagtgtgggccgcgccttcctggagtactaccaagagcacctggcgtacgcctgccccacggaggacatctacctggagtagcctgcccaccgctctgtctcctggccgtctgctccaggcgcagctggggctgaggatgtctcaagaggccaccatggctttggcaaggactggattggggggacatgggaccttacgcttgtgggggtctgcgggctgggaactctcgtcctcggtccccagggcgcagctgttggggctgcgggggagtggagcccccgtgcccctgcttttcctcagatccgttctttctctgtgttgtcctcctccttcccttcccagtctcccttttctctctcctggtgtctctgcccctctctgtgcctgcaaaccttatcctctattcttcactttggggtcagaacttcgggggtgtggaggaggtgcggctctagggacaggtaatgtcggcttccaagtgatgccctcctgccactcccctgcgatttataagggaattttaatttttatagtgaatctcaagggatcatcccatccttgaccacagggacaagaggggccccctcgccccagccccaccccacatggagctcagggggaagcagggaggggttcccaaaagagccctgcggaggctaggagtggttcttgatgctcacctgaagcccctagacgctgctaggagggggggccctcctgggcccccaatacccctccgcttgccgctgctagcgcacccctgcagtccagcgtgcatccaccccacgcacgccccgtgctgtgttcctgggccctgcccatggcctcaataaactctctgcttggtgtgacaaaaaaaaaaaaaaa

SEQ ID NO: 563 - DNA, 2559 bp, Human
gcgggccgaggagccgggcgcaatggagcggaagaggtgggagtgcccggcgctcccgcagggctgggagagggaagaagtgcccagaaggtcggggctgtcggccggccacagggatgtcttttactatagcccgagcgggaagaagttccgcagcaagccgcagctggcgcgctacctgggcggctccatggacctgagcaccttcgacttccgcacgggcaagatgctgatgagcaagatgaacaagagccgccagcgcgtgcgctacgactcctccaaccaggtcaagggcaagcccgacctgaacacggcgctgcccgtgcgccagacggcgtccatcttcaagcagccggtgaccaagattaccaaccaccccagcaacaaggtcaagagcgacccgcagaaggcggtggaccagccgcgccagctcttctgggagaagaagctgagcggcctgaacgccttcgacattgctgaggagctggtcaagaccatggacctccccaagggcctgcagggggtgggacctggctgcacggatgagacgctgctgtcggccatcgccagcgccctgcacactagcaccatgcccatcacgggacagctctcggccgccgtggagaagaaccccggcgtatggctcaacaccacgcagcccctgtgcaaagccttcatggtgaccgacgaggacatcaggaagcaggaagagctggtgcagcaggtgcggaagcggctggaggaggcgctgatggccgacatgctggcgcacgtggaggagctggcccgtgacggggaggcgccgctggacaaggcctgcgctgaggacgacgacgaggaagacgaggaggaggaggaggaggagcccgacccggacccggagatggagcacgtctagggcaggtgctgcggggccacgggggctccctggagtcgggtcctggcagtggggactgcctggtgaacacagatgtgcttgggatgacgggtgcctcccaagagcttcccatctccctagaagagcccaagcgtccccgtcccgtggagtcgctaaagccagccctccctgtcctttccagaggccctgccgagagcccgtgctgcctgctggagccgcctgcagacgcggtcctcggccccacgtgaaccaggctcggcggcgaagcccagccttggagacacccaggaggaaggccgtgctcctggctccctcctcggcccgtccccacttcccggggcctcggggcacacagctggggctgcccccacccgaaagaccctccacgctcgtcctctacagagtccggcttcgggaagtgccgggtgctcctgggccctgcctggctccctacgacctttgggctcgaggccagctcctccccatgcccgctgtcccagctccttgagactggagagcagccagcaggtgcccggcagctcggcgccacggcttgctgacagctgggagggtttctcggtctggaggcgtagttttgaaactcacatcacccactgtgcagcgtgaggacgggactctggtctgctgtggggggcatgcaggacggcgccactctctgccctgccatgcggctggtggtgccacagagcctcaccgtgcctgagtggcatgcccaggaggccgctctccttcagtaaatgtaacacagtcgaggcacgtcatcgggcagccttccctgtgtgccaacgccagccttcgcttctgaaaaccaaactccagccgctgccagtcgggacttggtcgcccggcgctgccagaatgctccactgccagccggcccccctgcctcggtttcccttctgtttagtggcgacacaggcacccagctttggggtggtgctgacgctcccaggggtgccaggagccactgggacagggtgaggctcccagacgctcctcgaggtgcccagctctccagggagcttctggcccaaggccgtctgagggatctgctccttaaccccccagtgccttggcgagggcaggttccaagccacagacgcctgccccgagtggactctgcggccagtccctggtgccctcctggccctgctgcccagtgagggctcctacgggtgggttcattggcctgggcccagcgagcccccacctgcattgaccttaggcccatagagagggcctgtcccggtgctgccccagccaggatctggtcgctgccccagggggactgatgggcagagtcgcccctgtggctggactgtgaccatccctgatggggcctgaccgcgggagctgaggaagcgccgctccaccgtctgccctccaaggacccgcatggaggcagtgggctggcagcttcctgctgctccctgtcagagtcaaagcacaaatcctcaggacgggctcaagggccagggcagccgagggaagctccaggtggggaccacgtcttcctgaggttggtgcccactggctgggaccctttgcagtggggtggcctcccctctgtctgcctggtggagggagccgtgggcgtggggacgtgactgaataaagccaccatgggtggatgtgcttgg

SEQ ID NO: 564 - DNA, 1754 bp, Human
actcggcttccgtccattcttccggtggagatggctgcggccgtggcggggatgctgcgagggggtctcctgccccaggcgggccggctgcctaccctccagactgtccgctatggctccaaggctgttacccgccaccgtcgtgtgatgcactttcagcggcagaagctgatggctgtgactgaatatatccccccgaaaccagccatccacccatcatgcctgccatctcctcccagccccccacaggaggagataggcctcatcaggcttctccgccgggagatagcagcagttttccaggacaaccgaatgatagccgtctgccagaatgtggctctgagtgcagaggacaagcttcttatgcgacaccagctgcggaaacacaagatcctgatgaaggtcttccccaaccaggtcctgaagcccttcctggaggattccaagtaccaaaatctgctgcccctttttgtggggcacaacatgctgctggtcagtgaagagcccaaggtcaaggagatggtacggatcttaaggactgtgccattcctgccgctgctaggtggctgcattgatgacaccatcctcagcaggcagggctttatcaactactccaagctccccagcctgcccctggtgcagggggagcttgtaggaggcctcacctgcctcacagcccagacccactccctgctccagcaccagcccctccagctgaccaccctgttggaccagtacatcagagagcaacgcgagaaggattctgtcatgtcggccaatgggaagccagatcctgacactgttccggactcgtagccagcctgtttagccagccctgcgcataaatacactctgcgttattggctgtgctctcctcaatgggacatgtggaagaacttggggtcggggagtgtgtttgtcacttggttttcactagtaatgatattgtcaggtatagggccacttggagatgcagaggattccatttcagatgtcagtcaccggcttcgtccttagttttcccaacttgggacgtgataggagcaaagtctctccattctccaggtccaaggcagagatcctgaaaagatagggctattgtcccctgcctccttggtcactgcctcttgctgcacgggctcctgagcccacccccttggggcacaacctgccactgccacagtagctcaaccaagcagttgtgctgagaatggcacctggtgagagcctgctgtgtgccaggctttgtgctgagtgctgtacatgtattagttcctttactgctgaccacattgtacccatttcacagagaaggagcagagaaattaagtggcttgctcaaggtcatgcagttagtaagtggcagaacagggacttgaaccaagccctctgctctgaagaccgcgtcctgaatttcttcactagagcttcctcatcaggttacccagaagtgggtcccatccaccatccaggtgtgcttggatgttagttctccaccctcgaggtgtacgctgtgaaaagtttgggagcactgctttataataaaatgaaatatattctacttcctttattttgtggtttacacggttgtcctccctctaaacttactctcaggggcttctctgtcatctgactttcctcactcttgcttcccttcctaggaaaatcctcttcccctatacctgttcccacaaatggcatcccgcgcatgcttgccctattaaaggcagctgacagctgtacccactaaaaaa

SEQ ID NO: 565 - DNA, 1610 bp, Human
cttgacctctggcccaagatggtggcgcccagagcttcgctcttgctgctcccctgaggtgaactgaagccagcagccccgcatcatgtcaaagctcggccgggccgcccggggcctcaggaagcccgaggtcggcggtgtgatccgggcgatcgtgcgggcaggcctggccatgcccgggcccccactaggcccagtgctgggtcagagaggcgtttccatcaaccagttttgcaaggagttcaatgagaggacaaaggacatcaaggaaggcattcctctgcctaccaagattttagtgaagcctgacaggacatttgaaattaagattggacagcccactgtttcctacttcctgaaggcagcagctgggattgaaaagggggcccggcaaacagggaaagaggtggcaggcctggtgaccttgaagcatgtgtatgagattgcccgcatcaaagctcaggatgaggcatttgccctgcaggatgtacccctgtcgtctgttgtccgctccatcatcgggtctgcccgttctctgggcattcgcgtggtgaaggacctcagttcagaagagcttgcagctttccagaaggaacgagccatcttcctggctgctcagaaggaggcagatttggctgcccaagaagaagctgccaagaagtgacccttgccccaccaactcccagatttcaaaggaggtagttgcaaaagctgtgcccaaggggaggaaggaggtcacaccaatatgatgatggttttcatgactttgaatgatatatttttgtacatctagctgtatcgaggcatcaggcctgaataaacatcctttcttacccactgtcatcttctatcttgggacctcagggaagggaaccagtactggtggtagccaatatgggcagacattaggaaattggggtcttcatactgcttctcagatgtgcaaactgaggttcagccaagcaaagtaacttgcccaggtccttttttttcttttttaagttataattttgttttattgcccaggttctgaattggtgccagaggtaggaatagaacccaggccttctcatttgaaatcctgtgttcttcccctccccagggtgggaactatggttgctagggctgaggtgtattgcttacttcttccatcaaaaatctcttttatctctgaacaacttgccacctctgcagaaacaagtccctgtggagatctcagttcagccccaggcagggttactacatggagtacccagatcccaggggctacttcaggcccttctactaagctcctgaccctggctctgggtcagatgttggctgaacatgaactattgtagggctgacagctacagaccacagaaagagcaaagcttcagtaggttcctgcctgatggagaagtcctcgggaagcccttggccttctatttcctcattgtcctttcagagaagagagcaggagttgggggagaaaggagattcgcatttactgaccatctgttatgtgctagacacttcattttacactgagaaaatatggaaagcatagataaacacctaaaagaaaataaaaacctcatgttatcccaccaaaaaaaaaaaaaaaaaaa

SEQ ID NO: 566 - DNA, 3981 bp, Human
cgacaggggcggctctttcctgggtggggtttgtgaagtcgtggcccgttagcaggaagcctaacagtcgccccgacgctagtgagggacccaatctgagtccccggccagccgaatccaagccgtgtgtactgcgtgctcagcactgcccgacagtcctagctaaacttcgccaactccgctgcctttgccgccaccatgcccaaaacgatcagtgtgcgtgtgaccaccatggatgcagagctggagtttgccatccagcccaacaccaccgggaagcagctatttgaccaggtggtgaaaactattggcttgagggaagtttggttctttggtctgcagtaccaggacactaaaggtttctccacctggctgaaactcaataagaaggtgactgcccaggatgtgcggaaggaaagccccctgctctttaagttccgtgccaagttctaccctgaggatgtgtccgaggaattgattcaggacatcactcagcgcctgttctttctgcaagtgaaagagggcattctcaatgatgatatttactgcccgcctgagaccgctgtgctgctggcctcgtatgctgtccagtctaagtatggcgacttcaataaggaagtgcataagtctggctacctggccggagacaagttgctcccgcagagagtcctggaacagcacaaactcaacaaggaccagtgggaggagcggatccaggtgtggcatgaggaacaccgtggcatgctcagggaggatgctgtcctggaatatctgaagattgctcaagatctggagatgtatggtgtgaactacttcagcatcaagaacaagaaaggctcagagctgtggctgggggtggatgccctgggtctcaacatctatgagcagaatgacagactaactcccaagataggcttcccctggagtgaaatcaggaacatctctttcaatgataagaaatttgtcatcaagcccattgacaaaaaagccccggacttcgtcttctatgctccccggctgcggattaacaagcggatcttggccttgtgcatggggaaccatgaactatacatgcgccgtcgcaagcctgataccattgaggtgcagcagatgaaggcacaggcccgggaggagaagcaccagaagcagatggagcgtgctatgctggaaaatgagaagaagaagcgtgaaatggcagagaaggagaaagagaagattgaacgggagaaggaggagctgatggagaggctgaagcagatcgaggaacagactaagaaggctcagcaagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggccttggaaatggcagagctgacagctcgaatctcccagctggagatggcccgacagaagaaggagagtgaggctgtggagtggcagcagaaggcccagatggtacaggaagacttggagaagacccgtgctgagctgaagactgccatgagtacacctcatgtggcagagcctgctgagaatgagcaggatgagcaggatgagaatggggcagaggctagtgctgacctacgggctgatgctatggccaaggaccgcagtgaggaggaacgtaccactgaggcagagaagaatgagcgtgtgcagaagcacctgaaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaccaaacctagccccttagcccccacccacttccctgggcaaatgaatggctcactatggtgccaatggaacctcctttctcttctctgttccattgaatctgtatggctagaatatcctacttctccagcctagaggtactttccacttgattttgcaaatgcccttacacttactgttgtcctatgggagtcaagtgtggagtaggttggaagctagctcccctcctctcccctaccactgtcttcttcagggtcctgagatttacacggttggagtgttatgcggtctagggaatgagacaggacctaggatatcttctccaggatgtcaactgacctaaaatttgccctcccatcccgtttagagttatttaggctttgtaacgattgggggataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctccaaagaggtgactgggccctgcctctgtttgacaaacctctaacccaggtcttgacaccagctgttctgtcccttggagctgtaaaccagagagctgctggggattctggcctagtcccttccacacccccaccccttgctctcaacccaggagcatccacctccttctctgtctcatgtgtgctcttcttctttctacagtattatgtactctactgatatctaaatattgatttctgccttccttgctaatgcaccattagaagatattagtcttggggcaggatgattttggcctcattactttaccacccccacacctggaaagcatatactatattacaaaatgacattttgccaaaattattaatataagaagctttcagtattagtgatgtcatctgtcactataggtcatacaatccattcttaaagtacttgttatttgtttttattattactgtttgtcttctccccagggttcagtcctcaaggggccatcctgtcccaccatgcagtgcccctagcttagagcctccctcaattccccctggccaccaccccccactctgtgcctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggttttttaaaaattgtttttggaggggtttatgctcaatccatgttctatttcagtgccaataaaatttaggaagacttcaaaaaaaaaaaa

SEQ ID NO: 567 - DNA, 2662 bp, Human
ccgcggcacccacgtgcagcggctgggcccggcgctttcaggggaccaccaggcccccagagcgccgtgctatgttgggggctagtcactagcacggggctggaagctgagatcaaagacgccaatgagccggcgtgggtggatgagtgaggcgggcaagaagcagcaccggttagcctgagggttcgctccagggccaggcctggagccagcgcccttacctgcccctggaaagtctgagaccactcggggcggggcggctgccggagggtgggctgcggctccgtggcgggttccagaggggcggagccaagggctgggcgttcccgcgggcggggcgtcccgggggcggggcgggcccctgtgtttgttgcaccgtgtcagttactttgtaacaaaagtgctgcagccgcttgctccggccggcaccctaggccggcccgccgccagctgtcgccgacatggaacccttggccagcaacatccaggtcctgctgcaggcggccgagttcctggagcgccgtgagagagaggccgagcatggttatgcgtccctgtgcccgcatcgcagtccaggccccatccacaggaggaagaagcgacccccccaggctcctggcgcgcaggacagcgggcggtcagtgcacaatgaactggagaagcgcaggagggcccagttgaagcggtgcctggagcggctgaagcagcagatgcccctgggggccgactgtgcccggtacaccacgctgagcctgctgcgccgtgccaggatgcacatccagaagctggaggatcaggagcagcgggcccgacagctcaaggagaggctgcgcagcaagcagcagagcctgcagcggcagctggagcagctccgggggctggcaggggcggccgagcgggagcggctgcgggcggacagtctggactcctcaggcctctcctctgagcgctcagactcagaccaagtcttgcctaatgaaaacgggggaactcccaaccacagacccactggaagaggaaataatatcagttcccatcactgacactgttggccgtgccaggcagtgcacttaattctcacaacttgaggctgttctgtctccacttcacggatggtagaaatgaggctgagtgacgtgactcgcctgaggtccaaaaacagtgaagccaagattcaaaccagagccttccgactccagagctggggccaactgaattcaacaagtatttattgagtgtctattatgtgctagatactgagacacatcagagaacaaaaccaaaagccctgcccttgtcgggcttacagtctagcacttaccgccagttaacctgcaggctacctggagccccgggcaagtcaccgcacctctgtgcctcggtcctcagctgcccaatgggagaataagcagacctggctcagacatgaatcatgtgcttggtgtactgcagatgccaaactgcatccccacaacccaccacgtagacagcagacagggctggaagttgatttttaatgataaagtacaatgaagggagggcagagaggctaagcctagctgtctggggtgctgtggtggtggtagactggctacacaaactgttgctgctgctgctgcttcttggtggccgccttgctggcgaggtccttggccttctctgtagctgccagtgccgtctcctttgccttctccttggcttccttggctgtctcaacaagtgttttggaaggggcctcgcctgtcgcgaacggcaggtggctgcctttagaagatgcctgaaagaccaacctaatttccctcccccatgacaccaatctcctctgggccaggctccactaaaaaggtggtattcaccctcctcccacccccagtacagacaaggagtcccagctcagagcagggcaatgactaacccagactccacgcccgctaggctgaatgagcctctccctatgaggaatatccacatacccagaaactcaccttgcagcttagccaagatatattcaaaacccttcatagtcttggtcacgttgcttttgaatcgggcaagaccaaattcctggcatgagatgagaatgggaaggatactgagttgcccactgaccccagcccagccccaacaccgaaagcactgggtcccagagccccagcagccccaacaacactgctcacctggacagctctggagacaccaaataagctagaggagacccaggcttcccggcggatttcagtccagccactgttgtcagagttcacacagtaaacacatcgttcctccaccacctatgcagaggccaaccacaatcgtggaacagtctttcattttgccaacttgcacataaatctgactccctgtcacttttcatgaggcgaagcaatacaatgaaaatccattccttcccctgactgcacctccaagtggcactgacagaacaagaagccataaataaggtcgttttgctctcgaaaacctctcttctgactcttaaactagaaggcaaaaggtctctctcttgagatcaacaaagggccttccagcccatcctgctcctggattttgttttgtgcatctagacgcatgcagtgttttagccgccttccaccagctgcagctctggagcttcctgacagtccaaataaaaacatttgcccgg

SEQ ID NO: 568 - DNA, 3047 bp, Human
catcgcccgaggcgtccgccctgcaaatctgccagcccccgagaggggtttggaaccttagcacccaagtctaagtcaacttcatagtgtgaacatggctacgcctcttcattcccgtccatgccgagcccccgactgcagcattcaaagcccccacggaggttgagccgggcacagaaacacagcagcgggagcagcaacaccagcactgccaacagacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaacaaaactatacttgaacaaaagggtcagaggacctgtatttaagcaaatacttagcaaaaagtggggcagagcctcccaaggagaacaaatattcagaatattcatattggaaaaatcacaatttttaatggcagcagaaaacttgtgtgaaattttcttgatttgagttgattgagaagaggacattggagatgccatcctctttctcttttctagtttgctcatactacattgagtagacacatttaaggatggggttatgaacccttcctgagctttatggtcctaaaagcaaaataaaaactattcgaatgaaaagacaagaaaatcaggtattaatcttggatagctaataatgagctattaaaactcagcctgggacagtttatcatgaagcctgtggatgatcaatcctttattattattttttttttttgaaaaaagctcatttcatgctctgcaaaaggagagactcccatgaagccttttgaaagggatcatcatgcagctcaactttctgttggattccatgctaagcaagctaaccttatcctgcattgttagcactaggcacccagctgccacctctccatcctgctgcccttaggccacatgggagcagtccatgcatgacagcctctatcctacaaggcctatgagtatggattgggggggccaaaaggaaaaagctccatgtgcctctttgtctgcgtgggtcagaagagttgtgcacgcagattagcaggccaaggtctgagccacagcagcatttttatttcagattttgataactgtttatatgtgttgaaaaccaaaatgacatctttttaaagcttatccataaaaaaaaatagatgtcttttatagtggaaaaacacatggggaaaaaaatcatctattttgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagtagacacactatcatagttaacatagtaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccttgtggccctctcccttaccctgggaaggcctcttggagaccttacccctggctgtttggactttgtatactttaaataatttaactacccttaattacttaaaaaaaaaaaaaagctttatgattttcataacttattgctgattttaatggattgttaatttcagtcctgtagttttattttatgtttagatagggctgggcaaggaaaaagaaaataaagacaaccatatttagcagtgcagttgagttgtgtgttaatgttagactatccctttgtgagtgacactttaacagcattcactgcttctatatatagtgtaccatcttggtcatacattacgcctcaacatatacttgtgctcttcctttgcctccagaagaagtttttccttgattgtgctatgtttcagtggaagaaattctttgaagtagatgtgagtgaaaaactgcatgcctttagaagcccagtatcagaacttgctacgtttcaggtgctagggacttaatgaaaaacaggacaaaacaattcctttttgtggcccaggtaaattatttctggtttcacttataattactaatggctgagtcaagatgttgtctctgtgtttgcttactcttgatcaagtgtgagacagtttgaagactgtgctaccatacaaagtgaatgaagccagtgactaagcttctgtttgttttgttattctcatggccttcgcttgcattatttgggccttcattcagatgaacttgaggtgccattttgttgcatatgtacaggattatgggctggaaagcatttgttataaacctatagtgcacattttaactgccccctaaattacccttccctgggtttgttttccttggggtggtgtagattgtatgagtaagaagtattaattttttaaaagacaaatcaactttgaagacacaaaagttaattggaagaaataaaaactgtgaacgaagaa

SEQ ID NO: 569 - DNA, 2746 bp, Human
aagcccagccccgggacgagggaggagcgccttaagtgcccagcgggctcagaagccccgacgtgtggcggctgagccgggccccgcgcactttctcggccggggaggggttcgggctcgggcacccggagttggcccctcgtaacgccgcgggaaagtgcgggcgagggcagtggactctgaggccggagtcggcggcacccggggcttctagttcggacgcggtgccccctggtggcgctcaccgcgcgcgtggccttggcttccgtgacagcgctcggttggccgtcacagcagccctcggttggccctttcctgctttatagcgtgcaaacctcgccgcgccagggccaagggacaggttggagctgttgatctgttgcgcaattgctattttccccagagcggctttgtctttggatttagcgtttcagaattgcaattccaaaatgtgtaagacgggatattctcttctgtgctgtcaagggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggttgcccacattcccaaatcagatgctttgtactttgatgactgcatgcagcttttggcgcagacattcccgtttgtagatgacaatgaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttgacagtgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaaccaccctgaaagcacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtaggaggggtaagaataaagtggctgctcagaattgcagaaaaagaaaactggaaaatatagtagaactagagcaagatttagatcatttgaaagatgaaaaagaaaaattgctcaaagaaaaaggagaaaatgacaaaagccttcacctactgaaaaaacaactcagcaccttatatctcgaagttttcagcatgctacgtgatgaagatggaaaaccttattctcctagtgaatactccctgcagcaaacaagagatggcaatgttttccttgttcccaaaagtaagaagccagatgttaagaaaaactagatttaggaggatttgaccttttctgagctagtttttttgtactattatactaaaagctcctactgtgatgtgaaatgctcatactttataagtaattctatgcaaaatcatagccaaaactagtatagaaaataatacgaaactttaaaaagcattggagtgtcagtatgttgaatcagtagtttcactttaactgtaaacaatttcttaggacaccatttgggctagtttctgtgtaagtgtaaatactacaaaaacttatttatactgttcttatgtcatttgttatattcatagatttatatgatgatatgacatctggctaaaaagaaattattgcaaaactaaccactatgtacttttttataaatactgtatggacaaaaaatggcattttttatattaaattgtttagctctggcaaaaaaaaaaaattttaagagctggtactaataaaggattattatgactgttaaattattaaaa

SEQ ID NO: 570 - DNA, 7011 bp, Human
agttacatcagcctgggcagatgtctaaggatatgagaccgggggaagaaaaagttagaatctgtagcagaaggacgaagcttgccacctgcctactgggctgagcttttaatgtgatttacatttctaagctctatgtaggtgccctggaaatggtggtcttcattaatgcaaagattaagtctttaattaaactttttaagaagaaaacggtttccaacctagatgaggaaagccgatggacagtccactacactgccccgtggcaccagcaggagaatgtgttccttcccaccacaagacccccctgtgttgaggacctgcaccgccaagccaagctcaacctcaaatcagtactgagggaatgcgataagttgcggcatgatggctaccgcagttctcagtactactctcagggacccacctttgcggccaacgccagcccattctgtgatgattaccaagatgaagatgaagaaacagatcaaaagtgttctctgtcttcatcagaagaagaaagatttatttccatcaggagacctaaaacaccagcctcaagtgacttctccgaccttaatactcagacgaactggaccaagtcgcttccactgccaacaccagaagagaagatgcgacagcaagcccaaacagtccaggctgacgtggtgcctattaacataactggggagaatttcgatcgccaggccagccttcggcggtctctaatttacacagacactctggtaagacgaccgaagaaagtcaaaaggagaaagactattacaggagtccctgacaacatacagaaggagctagcatcaggcactggccaagatgatgctgatggccactcagtgtacacccctgatcactactctacactaggaaggttcaatagctgtcggtctgctgggcagcgctcagaaaccagggactccagctgtcagacggaggatgtgaaggtcgtaccaccttccatgaggagaatcagggcacagaaggggcaaggcattgctgcccagatgggccacttctcaggttcctctggcaacatgtctgtgctgagcgattctgcagggatcgtattcccttcccgccttgacagtgatgctggcttccatagtcttccgcgttctggagcaagggcaaacattcagtcccttgagccgaggctgggtgccctcggccctgcaggagacatgaatggcactttcctctaccagagaggtcacccacaagcagatgaaaacttaggccatttaggaggtgcctcagggactggaacacttttgagacccaaatcccaggagttgagacacttcgagagtgaaaatataatgagcccagcgtgtgtggtttctcctcatgcaacctactccaccagcatcatcccaaatgccacactgtcttcctcttccgaggtcatcgctattcccactgctcagagtgcgggacagcgggaaagtaaaagttctggctcatcacatgcaaggataaaatccagagaccacctcatctccaggcatgctgtgaaaggtgatcctcagtctcccggtcgccactggaatgagggccatgccaccattctttcacaggacttagaccctcattcccctggtgaacccgcactgttgtccctctgtgactcagccgtccctctaaatgctccagcaaatagggagaatgggtcccaagctatgccgtataattgtagaaacaacctggccttcccagcccacccccaagatgtggatggcaagagtgaatctagttattcagggggcggagggcacagcagctcggagccctgggaatacaaatcctcaggtaatggaagggcatcccccctgaagccgcatttagcaactcctggctattccactcccacaagtaacatgagcagctgcagtttggaccaaacgtccaacaaagaggatgctgggtcgctgtattctgaggaccacgatggctactgtgcatctgtgcacactgactctggacatggatctgggaatctgtgcaatagcagtgatggctttgggaaccccaggcacagcgtgatcaatgtttttgttggaagagctcagaaaaaccaaggggaccggtccaattaccaggataaatccctatcaagaaacatctctttgaagaaagcaaagaagcctcccctgccaccctcccggacagactccctccgcaggattcccaagaagagcagccagtgcaacgggcaggtgctcaacgagagcctgatcgccacactccagcactcgctgcagctgagcctcccaggcaagagtggcagctcgccctcccagagcccctgcagtgacttggaagagccctggctgccccgctcccggagccagagcacagttagtgctggcagcagcatgacttccgccaccacccccaatgtctactccctgtgcggggccacgccatcgcagagtgacacaagcagcgtcaagtcagagtacacggacccctggggttattacattgactacacgggcatgcaggaagatccggggaacccggcagggggctgttcaaccagcagtggggtgcccactgggaacgggccagtccgccatgtccaagaagggtccagagccacaatgccccaagtgcccggtggttcagtcaaaccaaagatcatgtcaccagagaagtcacacagagtcatttctccatccagtgggtattccagccagtcgaatacacccacagcactcacccctgtgcctgtgtttttaaaatcagtgtcaccagcaaacgggaaggggaagcccaagcccaaggtaccagaaaggaagtcctctctgatatcttcagtatccatttcctcatcgtccacttctctttcttctagtacttctactgaaggaagtggcactatgaagaagctggatccagccgtgggctctcccccggctcctcctcctcctcctgttccctctcctccattcccttgtcctgcagacaggtctcctttccttcctcccccacctcctgtcacagattgctcccagggctctcctctgcctcactctcctgtgttcccccctccgccgccagaagctctcattcctttctgctccccacctgattggtgcctttctcctccccgccctgcactgagccccattcttccagattcacctgtgtccttgccattgcccccacctctcttaccttcctcggaacccccacctgccccacctcttgaccccaaattcatgaaagacaccaggccgcctttcacaaattctggccagccagaatcctcccggggatccttgaggccgccttctaccaaggaggagaccagcaggccccccatgcccctgataaccacggaagcattgcagatggtgcagttgaggcccgtgagaaagaactcaggcgctgaggcggcacagttgtctgaacgaacagctcaggaacaacgaactccagttgctccacagtaccacttaaagccatctgctttcctgaaatcccgaaatagcacaaatgaaatggagagtgaaagccagcctgcctctgtgacaagctcgcttccgacgcctgccaagagctcgagtcagggtgaccatggcagtgcggctgagcgtggtggccctgtgagccgcagccctggagctccaagcgctggggaggcagaggctcggcccagccccagcaccaccccactcccagactcttcacccagcaggaagccaccccccatttccaagaagcccaaactgttcctggtggtaccacctccgcagaaagattttgcagtggagcccgcagagaacgtgagcgaagccctccgagctgtgcccagccccacgacgggagaggagggctctgtgcacagcagggaggcaaaagagagttctgcagcccaagctggctctcatgccacgcaccctggcacctcggttcttgagggaggagctgcaggatccatgtctcccagcagagtggaagccaatgtccccatggttcagcctgatgtctcaccagcccccaagcaggaggagccagccgagaacagtgcggatactgggggcgatggggagagctgcctatctcaacaggacggagcagctggggtgccggagaccaacgcagccggttcatcctcagaggcctgtgacttcctcaaggaagacgggaatgatgaggtaatgacccccagtcgacccaggaccacagaagacctttttgcagctattcacagatccaaaaggaaagtcctcggccgtagagattcagatgatgaccactcccgaaaccattctccctccccgcccgtgacacccaccggcgctgccccaagcctggcctctccaaagcaagtggggtcgattcagagaagcatccgaaagagcagcaccagcagtgacaacttcaaagctctgctgctgaaaaagggcagtcgttcagacaccagcgcccgcatgtctgcagcagagatgctcaagaacacagaccctagattccagaggtcgaggtcagagccttccccagatgcccccgagagcccgtcaagctgctccccaagcaagaacagaagggcgcaggaggagtgggccaagaacgaaggcttgatgcctcggagtctgtccttttccggccccaggtacggccgcagccgaacgccgccttctgccgccagcagcaggtacagcatgcggaaccggatccagagcagccccatgaccgtcatctcggagggagaaggggaagccgtggagcctgtggacagcatagcccgcggggctctgggcgctgcggagggatgttccctggacggactggcgagggaggagatggacgagggcggcctgctctgtggggaggggcctgccgcctccctgcagccccaggcccccggccctgtggatgggacagccagtgcagagggcagagagccctccccacagtgtggcggttctctgagcgaggagagttagggccaagaacgtaactctcccaggtgacacggggggagacgagcaatgcagcactctaggaagcctgctaggcgcccttccctggctcacccggggagcccactctgcttctgtgctgtgggccccggggttgccagccctgcagtgtgagtgaacggttatttaggactcacctggcacttgccctgtggcttaagaacaagtagaagcttaaacttctgaaagtgcttcccggggaagattttttttttttttttttttttttgctaaatgctgggtgtgtatgtgtgcattttccacactttttaatttttaaaaaatacacatatacacaaacaacatgtacagaaatagaagaaagcaagccagacttaagcttggtagagtaacggagtcctctggtctaggcggtaattgctttcagagaattacgtttatagaaatcagcgagttttgtaagaaaggagaagatgttacttcaagaaagaggcagtagagttgctggttcttaatgcacagaacacacagatatatgcacacgtgtgctgctgaggtgaggcaggtctggtgagcacggagaggctgggaaggggctaagtgactaattggttcaggtacttttttctgggggaggtagactttgcttcttttttgtaaaaatgacaaacgtagaagtggcaatgctgtaacctggtgcctgctgctgtgcagccacatacacacaattgtagcctgatttttagaagtgtgggtaattttttaatgaatttcctccttgagtagcagctgaggtcattgacaactgaagtgatggtgtggacatagagagaggggaagggttggaaaggagtaagtgatacactgctggaatttgtttcctgcctatgaaataaaattatttttcagaattaaatttgaaaacttgcactacagaactatgggtggagcttttccttttacaacagtttttttttttttttttttttaaccagagtttaaacttccattaggcaatttcctgtcacttgaaatgtcaacatttgctaacttttggatatccttttggttacaccaaagaaaaagttatggctatttttttttccttgaactgcctacagtatcatgtcctaattcagaaagatttatcaaaatctattatatattatcttactttgaagaaaatgctgaatagctcttgttagtcaaataaactgataaaaattggtagggcctggctatcaattagccctgggaaatgaatttttagattaaaaaggtttttttgcatcatttggtttgtgcatttttatatttgtttataaataattgagttgctaattacttctaatcttctccaatcagattttcaacaattttagacatgggacacacgtgtgtgaagtctttattttaatgtaataatctcattacccccacccttactcccttaacttccatgtacttagactcctttatttgttaaataaactagagtattgtcttcttcattagaaggacctaggatgacaatgcggagagtcttggtctgaatctagtgcgactaccacctgccagcttttggggggtatggaaatactatctaaaagttggactgcatgggtcaaatcattatgagacttataaactaaaactttagatacccatatagaaatgtctttgaggcaaaaacaaacctaaagaatgaaggctctttcccttctctgaaaaaaacaaaacactgctcttcacacaaccggaagtcaagaccagagatttggagcaattgtctactaatttggcacaaagatcgtttctttagaaaagtggcattggcttttgaatatgaaatcttctcatagctgcctaaaaaagactagaatgtatatggatatcagaaacctttaataatacataatttatgcaaagataagataaagcaacataacactaattataaaactatttttaaatccccatttttaatgaaaaatatacatttgtatttaatttcctttgaataaaacaattgtaaagtaaa

SEQ ID NO: 571 - DNA, 1338 bp, Human
taggtggcgggcgggtacttaaggcgcggccaccgcggctgcggcagtgcgcccaacagcggactccgagaccagcggatctcggcaaaccctctttctcgaccacccacctaccattcttggaaccatggcggcagtggcggcggcctcggctgaactgctcatcatcggctggtacatcttccgcgtgctgctgcaggtgttcctggaatgctgcatttactgggtaggattcgcttttcgaaatcctccagggacacagcccattgcgagaagtgaggtgttcaggtactccctgcagaagctggcatacacggtgtcgcggaccgggcggcaggtgttgggggagcgcaggcagcgagcccccaactgaggccccagctcccagccctgggcggccgtatcatcaggtgctcctgtgcatctcggccagcacgggagccagtgccgcgcaggaatgtggggtcccctgtgttccctcgccagaggagcacttggcaaggtcagtgaggggccagtagacccccggagaagcagtaccgacaatgacgaagataccagatcccttcccaacccctttgcaccggtcccactaaggggcagggtcgagagaggaggggggatagggggagcagacccctgagatctgggcataggcaccgcattctgatctggacaaagtcgggacagcaccatcccagccccgaagccagggccatgccagcaggccccaccatggaaatcaaaacaccgcaccagccagcagaatggacattctgacatcgccagccgacgccctgaatcttggtgcagcaccaaccgcgtgcctgtgtggcgggactggagggcacagttgaggaaggagggtggttaagaaatacagtggggccctctcgctgtcccttgcccagggcacttgcattccagcctcgctgcatttgctctctcgattcccctttcctcctcactgcctcccaagcccaccctactccaaaataatgtgtcacttgatttggaactattcaagcagtaaaagtaaatgaatcccacctttactaaaacactttctctgaaccccccttgcccctcactgatcttgcttttccctggtctcatgcagttgtggtcaatattgtggtaatcgctaattgtactgattgtttaagtgtgcattagttgtgtctccccagctagattgtaagctcctggaggacagggaccacctctacaaaaaataaaaaaagtacctcccctgtctcgcacagtgtcccaggaccctgcggtgcagtagaggcgcaccaaaaaaaaaaaaaaaaaaaaaaaaaaaaaaaaaaaaaa

SEQ ID NO: 572 - DNA, 2212 bp, Human
gccgcgagggcggggcccgcagttcggttgcgctgcggagcgcagctgtgagggagtcgctgtgatccggggccccggaacccgagctggagctgaagcgcaggctgcggggcgcggagtcgggaggcctgagtgttccttccagcatgtcggagggggagtcccagacagtacttagcagtggctcagacccaaaggtagaatcctcatcttcagctcctggcctgacatcagtgtcacctcctgtgacctccacaacctcagctgcttccccagaggaagaagaagaaagtgaagatgagtctgagattttggaagagtcgccctgtgggcgctggcagaagaggcgagaagaggtgaatcaacggaatgtaccaggtattgacagtgcatacctggccatggatacagaggaaggtgtagaggttgtgtggaatgaggtacagttctctgaacgcaagaactacaagctgcaggaggaaaaggttcgtgctgtgtttgataatctgattcaattggagcatcttaacattgttaagtttcacaaatattgggctgacattaaagagaacaaggccagggtcatttttatcacagaatacatgtcatctgggagtctgaagcaatttctgaagaagaccaaaaagaaccacaagacgatgaatgaaaaggcatggaagcgttggtgcacacaaatcctctctgccctaagctacctgcactcctgtgacccccccatcatccatgggaacctgacctgtgacaccatcttcatccagcacaacggactcatcaagattggctctgtggctcctgacactatcaacaatcatgtgaagacttgtcgagaagagcagaagaatctacacttctttgcaccagagtatggagaagtcactaatgtgacaacagcagtggacatctactcctttggcatgtgtgcactggagatggcagtgctggagattcagggcaatggagagtcctcatatgtgccacaggaagccatcagcagtgccatccagcttctagaagacccattacagagggagttcattcaaaagtgcctgcagtctgagcctgctcgcagaccaacagccagagaacttctgttccacccagcattgtttgaagtgccctcgctcaaactccttgcggcccactgcattgtgggacaccaacacatgatcccagagaacgctctagaggagatcaccaaaaacatggatactagtgccgtactggctgaaatccctgcaggaccaggaagagaaccagttcagactttgtactctcagtcaccagctctggaattagataaattccttgaagatgtcaggaatgggatctatcctctgacagcctttgggctgcctcggccccagcagccacagcaggaggaggtgacatcacctgtcgtgcccccctctgtcaagactccgacacctgaaccagctgaggtggagactcgcaaggtggtgctgatgcagtgcaacattgagtcggtggaggagggagtcaaacaccacctgacacttctgctgaagttggaggacaaactgaaccggcacctgagctgtgacctgatgccaaatgagaatatccccgagttggcggctgagctggtgcagctgggcttcattagtgaggctgaccagagccggttgacttctctgctagaagagaccttgaacaagttcaattttgccaggaacagtaccctcaactcagccgctgtcaccgtctcctcttagagctcactcgggccaggccctgatctgcgctgtggctgtccctggacgtgctgcagccctcctgtcccttccccccagtcagtattaccctgtgaagccccttccctcctttattattcaggagggctgggggggctccctggttctgagcatcatcctttcccctcccctctcttcctcccctctgcactttgtttacttgttttgcacagacgtgggcctgggccttctcagcagccgccttctagttgggggctagtcgctgatctgccggctcccgcccagcctgtgtggaaaggaggcccacgggcactaggggagccgaattctacaatcccgctggggcggccggggcgggagagaaaggtggtgctgcagtggtggccctggggggccattcgattcgcctcagttgctgctgtaataaaagtctactttttgctaaaaaaaaaaaaaaa

SEQ ID NO: 573 - DNA, 1637 bp, Human
acgcaaccccataaggtagcacgccgttacccgtggggagcgtttccgccatttttgaaaattaattgggaaggtactggttttaagtgtagttgccgacgcaatggcagcctttgcagtggaacctcaggggcccgcgttaggatctgaaccaatgatgctgggttcacccacatctccaaagccaggagttaatgcccagttcttacctggatttttaatgggggatttgccagctccggtgactccacaacctcgatcaattagtggcccttcagtaggagtaatggaaatgagatcacctttacttgcaggtgggtcaccaccacaaccagttgtaccagctcataaagataaaagtggcgctccaccagttagaagtatatatgatgacatttctagcccaggacttggatcaacacctttaacttcaagaagacagccaaacatttcagtaatgcagagtcctcttgttggagttacatctactcctggaacagggcaaagtatgtttagtccagcaagtatcggtcagccacgaaagacgacattatctcctgcccagttggatcctttttatactcaaggagattctttgacttcagaagatcacctcgatgactcttgggtgactgtatttgggtttcctcaagcatctgcttcctacatattactacaatttgcacagtatgggaatatcttaaaacatgtgatgtctaatacaggaaattggatgcatattcgttatcaatctaaactgcaggctcggaaagccttaagcaaagatgggaggatttttggagaatccatcatgattggtgtaaaaccatgtattgacaaaagtgttatggaaagcagtgacagatgtgctttatcatctccatctttagcctttacaccaccaatcaaaactctaggtacaccaacacaacctggaagtactcctaggatttctaccatgagacctcttgctacagcatacaaagcctctactagtgattatcaggttatttctgacagacaaacgccaaaaaaagatgaaagtcttgtatccaaagcaatggagtacatgtttggctggtagtagaacaccaagaaggaggttgctacactaaaacagagttagcagagtgctgctggttccttcggttagttatataactgttcctgcagtattggatagctatctcatacttcttttagaaagaagcctttttcattaaggatacaacctatttgtagctcgcactttaaaagatgcttgagatacattttaaagaaaactaaaaatccctgtaaataggattttgtgctttctgtaacagtgcatgcttcagcacagaaaactcagcattgattattgtaaattaaataactgaaattgtggtgagacgtcatagtcttcatgagaacgtgggggtgaatttcatgaaggggaactatagttatttctaccgacacaaatattataattagcaatttgaattatggtcttttaatttagatagtatttaatattttaattatccttgtttgtatatgtcctgtcacagagtgtcctcttggtgtattctaaaacgagcattcttttaaaaaacctaaagtttcttgataataaacattgtcaatgatatgtg

SEQ ID NO: 574 - DNA, 1644 bp, Human
gcgcgcgggtttcgttgacccgcggcgttcacgggaattgttcgctttagtgccggcgccatggggtcggagctgatcgggcgcctagccccgcgcctgggcctcgccgagcccgacatgctgaggaaagcagaggagtacttgcgcctgtcccgggtgaagtgtgtcggcctctccgcacgcaccacggagaccagcagtgcagtcatgtgcctggaccttgcagcttcctggatgaagtgccccttggacagggcttatttaattaaactttctggtttgaacaaggagacatatcagagctgtcttaaatcttttgagtgtttactgggcctgaattcaaatattggaataagagacctagctgtacagtttagctgtatagaagcagtgaacatggcttcaaagatactaaaaagctatgagtccagtcttccccagacacagcaagtggatcttgacttatccaggccacttttcacttctgctgcactgctttcagcatgcaagattctaaagctgaaagtggataaaaacaaaatggtagccacatccggtgtaaaaaaagctatatttgatcgactgtgtaaacaactagagaagattggacagcaggtcgacagagaacctggagatgtagctactccaccacggaagagaaagaagatagtggttgaagccccagcaaaggaaatggagaaggtagaggagatgccacataaaccacagaaagatgaagatctgacacaggattatgaagaatggaaaagaaaaattttggaaaatgctgccagtgctcaaaaggctacagcagagtgatttcagcttccaaactggtatacattccaaactgatagtacattgccatctccaggaagacttgacggctttgggattttgtttaaacttttataataaggatcctaagactgttgcctttaaatagcaaagcagcctacctggaggctaagtctgggcagtgggctggcccctggtgtgagcattagaccagccacagtgcctgattggtatagccttatgtgctttcctacaaaatggaattggaggccgggcgcagtggctcacgcctgtaatcccagcactttgggaggccaaggtgggtggatcacctgaggtcaggagctcgagaccagcctggccaacatggtgaaaccccatctctactaaaaatacaaaaattagccaggtgtgatggtgcatgcctgtaatcccagctcctcagtaggctgagacaggagcatcacttgaacgtgggaggcagaggttgcagtgagccgagattgcaccaccgcactccagcctgggtgacagagcgagacttatctcataaataaatagatagatactccagcctgggtgacagagcgagacttatagatagatagatagatagatggatagatagatagatagatagatagatagataaacggaattggagccattttgctttaagtgaatggcagtcccttgtcttattcagaatataaaattcagtctgaatggcatcttacagattttacttcaatttttgtgtacggtattttttatttgactaaatcaatatattgtacagcctaagttaataaatgttatttatatatgcaaaaaaaaaaaaaaaaa

SEQ ID NO: 575 - DNA, 2642 bp, Human
actttcaaaatggcggagtgtggagcgagcggcagcgggagcagcggggacagtctggacaagagcatcacgctgccccccgacgagatcttccgcaacctggagaacgccaagcgcttcgccatcgacataggcgggtcgttaaccaagctggcctactattcaacggtacagcacaaagtcgccaaggtgcggtctttcgaccactccggaaaggacacagaacgtgaacatgagccgccctatgagatttcagttcaagaagagatcactgctcgactgcacttcattaagtttgagaatacctacatcgaagcctgcctggacttcatcaaagaccatctcgtcaacacagagaccaaggtcatccaggcgaccgggggcggggcctacaagttcaaggacctcatcgaagagaagctgcggctgaaagtcgacaaggaggacgtgatgacgtgcctgattaaggggtgcaacttcgtgctcaagaacatcccccatgaggccttcgtgtaccagaaggattccgaccctgagttccggttccagaccaaccacccccacattttcccctatcttcttgtcaatatcggctctggagtctccatcgtgaaggtggagacggaggacaggttcgagtgggtcggcggcagctccattggaggcggcaccttctgggggcttggcgctctgctcaccaaaacgaagaagtttgacgagctcctgcacctggcctcgaggggccagcacagcaatgtggacatgctggtgcgggacgtctacggcggcgcccaccagactctcgggctgagcgggaacctcatcgccagcagcttcgggaagtcggccaccgccgaccaagagttctccaaagaagacatggcgaagagcctgctgcacatgatcagcaacgacattgggcagctggcctgcctccacgcacggctgcacagcctggaccgcgtgtactttggaggcttctttatccggggccaccccgtgaccatgcgcaccatcacctatagcatcaacttcttctccaagggggaagtgcaggcgctgtttctgaggcacgaaggctacctgggagccatcggagcgttcctgaaaggagctgagcaggacaatcctaaccagtacagctggggagagaactatgcaggcagctccgggctgatgagtgcatcacccgagctcggcccggcgcagcgggcgcggagtggcacttttgacttgctggaaatggaccggctggagaggccactggttgacctgccgctcctcctggacccgccctcctacgtgcccgacacggtggacctcaccgatgacgctctggcccgaaaatactggctcacctgctttgaggaggccctggacggggtagtgaagcgcgcagtggcgagccagccagactctgtggatgcagccgagagggcggagaagttccggcagaagtactggaacaagcttcagaccctgaggcagcagcccttcgcctatgggaccctgaccgtgcgcagcctgctggacaccagggagcactgtctgaacgagttcaacttcccggatccctactccaaagtgaagcagcgggagaatggcgtggcgctgaggtgcttccccggggtcgtgcgctccctggacgcgctgggctgggaggaacggcagctggcgctggtgaaaggcctcctggcggggaatgtcttcgactggggggccaaagccgtgtctgctgtccttgaatccgacccctactttgggtttgaagaagcaaagaggaagttacaagaaagaccctggctcgtggattcctacagcgagtggcttcagagattaaaggggccccctcataaatgtgccttaattttcgcagataacagtggaatagacatcattttgggagtcttcccctttgtcagggagctactccttagagggacagaggtcatcctggcgtgcaactcaggccccgccctgaacgacgtgacccacagcgagtccctcatcgtggcagagcgtattgcgggcatggaccctgtcgtgcactctgcgctccaggaagagaggctgctgctggtgcagacgggctccagctccccgtgcctcgacctcagccgcctggataaggggctggccgcactggtgcgggagcgtggcgcggatctggtggtcatcgagggcatgggccgtgctgtccacacaaactaccacgcagccctgcgctgcgagagcctcaagctggccgtcatcaagaacgcgtggctggccgagcggctgggcggccggctcttcagcgtcatcttcaagtacgaggtcccagccgagtgaggcgctgcagctgccggactcttctgcttgtcacttgtcaggaatgtgtttttaccaccacagggaaactgcgttcaaatcaacgtatttatatggtactgctgtgacgcggcacatacaccccagccgcacagatgcgtgtgacccagaggcgagacgcagctttgtcctgggagacgttcatattggaatctatttaactgctaaagaaccttttatatatatatatatataaatagagagatctatacaggtatgtctgacgggacgcagcaccgtgggcacgcaccaaatagagtttttaaaagagg

SEQ ID NO: 576 - DNA, 3213 bp, Human
gaccgaagcaagagctggttcaggtggcagccacagcagcctcagggacctcagcaactatggcctcctgcccagactctgataatagctgggtgcttgctggctccgagagcctgccagtggagacactgggcccggcatccaggatggacccagaatctgagagagccctgcaggcccctcacagcccctccaagacagatgggaaagaattagctgggaccatggatggagaagggacgctcttccagactgaaagccctcagtctggcagcattctaacagaggagactgaggtcaagggcaccctggaaggtgatgtttgtggtgtggagcctcctggcccaggagacacagtagtccagggagacctgcaggagaccaccgtggtgacaggcctgggaccagacacacaggacctggaaggccagagccctccacagagcctgccttcaacccccaaagcagcttggatcagggaggagggccgctgctccagcagtgacgatgacaccgacgtggacatggagggtctgcggagacggcggggccgggaggccggcccacctcagcccatggtgcccctggctgtggagaaccaggctgggggtgagggtgcaggcggggagctgggcatctccctcaacatgtgcctccttggggccctggttctgcttggcctgggggtcctcctcttctcaggtggcctctcagagtctgagactgggcccatggaggaagtggagcggcaggtcctcccagaccccgaggtgctggaagctgtgggggacaggcaggatgggctaagggaacagctgcaggccccagtgcctcctgacagtgtccccagcctgcaaaacatgggtcttctgctggacaagctggccaaggagaaccaggacatccggctgctgcaggcccagctgcaggcccaaaaggaagagcttcagagcctgatgcaccagcccaaagggctagaggaggagaatgcccagctccggggggctctgcagcagggcgaagccttccagcgggctctggagtcagagctgcagcagctgcgggcccggctccaggggctggaggccgactgtgtccggggcccagatggggtgtgcctcagtgggggtagaggcccacagggtgacaaggccatcagggagcaaggccccagggagcaggagccagaactcagcttcctgaagcagaaggaacagctggaggctgaggcacaggcattaaggcaagagttagagaggcagcgacggctgctggggtctgtacagcaggatctggagaggagcttgcaggatgccagccgcggggacccagctcatgctggcttggctgagctgggccacagattggcccagaaactgcagggcctggagaactggggccaggaccctggggtctctgccaatgcctcaaaggcctggcaccagaagtcccacttccagaattctagggagtggagtggaaaggaaaagtggtgggatgggcagagagaccggaaggctgagcactggaaacataagaaggaagaatctggccgggaaaggaagaagaactggggaggtcaggaggacagggagccagcaggaaggtggaaggagggcaggccaagggtggaggagtcggggagcaagaaggagggcaagcgacagggcccgaaggaacccccaaggaaaagtggtagcttccactcctctggagaaaagcagaagcaacctcggtggagggaagggactaaggacagccatgaccccctgccatcctgggcagagctgttgaggcccaagtaccgggcaccccagggctgctcaggtgtggacgagtgtgcccggcaggagggcctgactttctttggcacagagctagccccagtgcggcaacaggagctggcctctctgctaagaacatacttggcacggctgccctgggctgggcagctgaccaaggagctacccctctcacctgctttctttggtgaggatggcatcttccgtcatgaccgcctccgcttccgggattttgtggatgccctggaggacagcttggaggaggtggctgtgcaacagacaggtgatgatgatgaagtagatgactttgaggacttcatcttcagccacttctttggagacaaagcactgaagaagaggtcagggaagaaggacaagcactcacagagcccaagagctgcggggcccagggaggggcacagccatagccaccaccaccaccaccggggctgacaccctgccccacagggaatggccttggcctggcccagcccaagatcccagcgttatctaactcctggagggtggactctgtcctggcttgtttggtgtcctcagatatctttcacacagtagagcaaaatcaccagccctgcactgatgtcactttatgtagaaaaaggccttagctggacctgcgttgccgtctatgcaaatgcatgcaaatactccaggccctgggatgtgggcttgtgttttgtcactgtgaagggggagatgggagaggagcctgttttggggtggggtctggggaaggcaatctgattctgaagctaaagagctttcatcctcttgagtgtatgtccccatagtgggccccttgacccacatgctgaccggtgccttgggatttgactagagttgctggctcgaggcccagcacgaggacttaccctggggttttgttaggtttggaagcagctgtccctagggggtgaagtcccccccctttttttttttacccctgcttctcccacggcttcacctccctatgtgaactgtagactcagatcccaataaagtgctgttgcagctatgatgctaggtggtttctaagcacaggggacaccccacaccccctgcctgaatggatgggtccatcccaggcactggtacttgcccccttgttctgtatccccctttgcccttgccttgcccttccaacaaaccctaggcccttgagaagctgatacttctccttttgctcacagctgccttggccccacccctgggagatgtagcaaattgagtgtgggttttggagtctgagcctcaggctcaaatccaggccaagtgatcttgggcaagttaatctctgggaactttgggtttcttatcctcaaaaaaggcgatggaagggctggggaagtgattaaataaaagcaacgcaagaaaaaaaaaaaaaaaaaaa

SEQ ID NO: 577 - DNA, 2188 bp, Human
tccgcgcctgtcaaacccctcattgttcgcagctgatgtcactcgcagttgtgagcggccgcctctcccggggacaatgtgggactgagcggcccagccgccgtgccgccgccgccgccgccgcaggacagccccagcgaggccatttccagcacatagaagagagattggaaaccaacgtgcagaactgccagtcccctgacacgctgtgccccacccactgcagcccagtgctgaatgaaccctgcccagaggtgtctgtagtgagcttctgccctagtgacttttgagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagactacgggtgcccaggtacaggtggcaggggacctgctccccaactccacagagcgagctgttacggtatctggggtgcctgatgccatcatcctgtgtgtgcgccagatctgcgctgttatcctggagtccccacccaaaggagccactatcccctaccatccgagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggctttaccacctgcttccccagggccgccgccgggcttggcggcctacactgccaagatggcagcagctaatgggagcaagaaggctgagcggcagaaattctccccctactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgaccaggaaaaaaaaaaaaaaaaaa

SEQ ID NO: 578 - DNA, 701 bp, Human
gcagggacccgcccgggactctgggtccccgcccatacctcaacttcgcacgactgcgtgcctcaagccgacgcagcggcctactctcgcactgcagacggggaaactgaggcctgaggcggccggggtggggcagacctcccggcgagcccgagcccccgcccccggctagccccgccctggcccgtaagaagcacccggggcgcgaggcgaaggcgcacagcgcggggccaggctgggtccagcagcgcgatggcagctcagcggctgggcaagcgcgtgctgagcaagctgcagtctccatcgcgggcccgcgggccagggggcagtcccggggggctgcagaagcggcacgcgcgcgtcaccgtcaagtatgaccggcgggagctgcagcggcggctggacgtggagaagtggatcgacgggcgcctggaggagctgtaccgcggcatgggactcctgaagtcatgtgggaaacctgtcgaggacttcatccaggagctgctggcaaagcttcaaggcctccacaggcagcccggcctccgccagccaagcccctcccacgacggcagcctcagccccctccaggaccgggcccggactgctcacccctgaccctcttgcactctccctgccccccggacgccgcccagcttgcttgtgtataagttgtatttaatggttctgtaacaataaaaaaa

SEQ ID NO: 579 - DNA, 3150 bp, Human
agtcactgcatcgggtccatctgtacaactctctccgtttctccgtctctctccctccctccctccctccacccccccaatctttttctccccatctctccatctctctcttatctcttcaggaagagcctaaaaggcggcaacaccaacacctcttgacatggaaatacactgatacaataggcaaaaggaaacactcgattgcatcttcccggttccaggtggccttatttgggagattctatactgaccttattcctgtgatggaggatactggcatccagcgaggcatctgggatggagatgccaaggctgtccaacaatgtctgacagatatttttaccagcgtttacaccacctgcgacatccctgagaatgctatatttggtccctgtgtcctgagccatacttccctatatgacagcatagctttcatagctctcaagtctactgacaagagaacagtaccgtatatctttcgggtagacacctcagcagcaaatggttcctcagaaggtctcatgtggctgcggttggtccaatcggccagagataaggaagagcagaaccttgaagcctacataaaaaacggacagctgttctaccgctctctccgcaggattgccaaagacgaggagttactagtttggtacgggaaagaactgactgagttactcttgctctgcccctctagatcccacaacaaaatgaatgggtcgtccccttacacatgcctggaatgcagccaacgtttccagtttgagttcccctatgtggcgcatctgcgtttccgctgccccaagagacttcacagcgctgatataagtccccaagacgaacaaggcggcggcgtgggcaccaaggaccacgggggcggcggcggcggtggcaaagaccagcagcagcagcagcaggaggcacctttaggcccgggtcccaagttttgcaaagccggccccctccaccactacccatccccctccccggaaagcagcaacccatccgctgccgccggcggcagcagcgcgaagccatccacagacttccacaacctggccagggagctggaaaactcccggggaggcagcagctgctccccagcccagagcctcagcagcggtagcggcagcggcggcggcggcggccaccaggaggcggagctgagtcccgacggcatcgccacgggcggcggcaaaggaaagaggaaattcccggaggaggcggcggagggcggcggtggcgctggtctggtagggggccggggccgcttcgtagagcggcccctcccggcctccaaggaggatctggtgtgcacaccgcagcagtaccgagcctcgggcagctacttcggcctggaagagaacggccgcctcttcgcgccgccaagtcccgagacgggcgaggcgaagcgcagcgccttcgtggaggtgaagaaggctgcccgcgcggccagcctgcaggaggaggggacagccgacggcgcgggagtcgcctccgaggaccaggacgctggcggcggcggcggctcctccacgcccgcggccgcgtcaccggtgggcgccgagaagctgctggccccgcggcctgggggcccgctgcccagccggctcgagggcggcagtcctgcgaggggcagcgccttcacttcggtgccgcagctgggcagcgcgggcagcaccagcggtgggggcggaacgggcgccggggccgcaggcggcgcgggcgggggccagggcgccgcgtcggacgagcgcaaaagcgccttctcgcagccagcacgctctttctcgcagctgtccccgctggtgctgggccagaagctgggcgcgctcgagccatgccaccccgccgacggcgtgggccccaccagactctatcccgccgccgcggaccctctagcggtgaagctccagggggccgcggacctgaacggaggttgcgggtccctgccgagcggcggcggcggcctgcctaagcagagccccttcctgtacgccaccgccttctggcccaagagctccgctgccgctgcagccgcggctgcggcggcggccgcggggcccttgcagctgcagctgccctcggcgctcacgctgctgccgccctccttcacctcgctgtgtctgcccgcgcagaactggtgcgccaagtgcaatgcctccttccgcatgacctccgacctggtgtaccatatgaggtcgcaccacaaaaaggagtatgcgatggagcccttggtgaagcggcggcgagaggagaaactcaagtgccccatctgcaatgagtccttcagggagcgccaccacctctccaggcacatgacctcgcataattgactcggaaaggaccccagctttccacgcgcgcgcaagcacagttaagccacctgcaggaataaacacgcgagaacatccaccgcttccttgcaccccgaaaccctgcacaaagacacatacattcaccgcccccccgcccccccaacgcgcacacacacgtcctctcctcccaggaacctcattcaaatatttacccgggacacacacccccccccacacacacacacagacacactcacacacaagagccaggatggtggagttttgattgggtgggttgtttgagggggttttcttttgaatgcacgcattttcactttccccaaaacaaaggtacattttttaaaatgtcatatattgcaacatattgatgcatttgtcatacgtttctacttaaattattaagcacttacgatttagatgtaataattatatgtaagggcaaaatttattttagatataaagtaaaggaggagggtgagatgctttctgcatttcttgatgacagtttgtgttcctacaaaaataaacaaaatgaataaaaagggatcaccattcaatttgagtttccagggggaagtgcatgtataatgaaatgataatggacttcaatgaagaatgtcatcaattatgtacatatgtattttcttttaatacaaagtgtaattttgtgccagtgaaatggagtctgaatagttatgtgtttcttttatccctggaaatatttattaaactttatagtttatccgagtatgttggatgctttgacaataaatgactattttcttcaaagcaaaaaaaaaaaaaaaaaaaaaaa

SEQ ID NO: 580 - DNA, 1558 bp, Human
gagtgcaaagcgctctccctccctcgcccagccttcgtcctcctggcccgctcctctcatccctcccattctccatttcccttccgttccctccctgtcagggcgtaattgagtcaaaggcaggatcaggttccccgccttccagtccaaaaatcccgccaagagagccccagagcagaggaaaatccaaagtggagagaggggaagaaagagaccagtgagtcatccgtccagaaggcggggagagcagcagcggcccaagcaggagctgcagcgagccgggtacctggactcagcggtagcaacctcgccccttgcaacaaaggcagactgagcgccagagaggacgtttccaactcaaaaatgcaggctcaacagtaccagcagcagcgtcgaaaatttgcagctgccttcttggcattcattttcatactggcagctgtggatactgctgaagcagggaagaaagagaaaccagaaaaaaaagtgaagaagtctgactgtggagaatggcagtggagtgtgtgtgtgcccaccagtggagactgtgggctgggcacacgggagggcactcggactggagctgagtgcaagcaaaccatgaagacccagagatgtaagatcccctgcaactggaagaagcaatttggcgcggagtgcaaataccagttccaggcctggggagaatgtgacctgaacacagccctgaagaccagaactggaagtctgaagcgagccctgcacaatgccgaatgccagaagactgtcaccatctccaagccctgtggcaaactgaccaagcccaaacctcaagcagaatctaagaagaagaaaaaggaaggcaagaaacaggagaagatgctggattaaaagatgtcacctgtggaacataaaaaggacatcagcaaacaggatcagttaactattgcatttatatgtaccgtaggctttgtattcaaaaattatctatagctaagtacacaataagcaaaaacaaaaagaaaagaaaatttttgtagtagcgttttttaaatgtatactatagtaccagtaggggcttataataaaggactgtaatcttatttaggaagttgacttatagtacatgataaatgatagacaattgaggtaagttttttgaaattatgtgacattttacattaaattttttttacattttttgggcagcaatttaaatgttatgactatgtaaactacttctcttgttaggtaatttttttcacctagatttttttcccaattgagaaaaatatatactaaacaaaatagcaataaaacataatcactctatttgaagaaaatatcttgttttctgccaatagattttttaaaatgtagtcagcaaaatgggggtggggaagcagagcatgtcctagttcaatgttgactttttttttttttaaagaaaagcattaagacataaaattctttcactttggcagaagcatttgttttcttgatgaaattatttttccatctgaggaaaaaaatactaggaaaataaatcaaggtgatgctgaaaaaaaaaaaaaaaaaa

SEQ ID NO: 581 - DNA, 1229 bp, Human
gtctgacgggcgatggcgcagccaatagacaggagcgctatccgcggtttctgattggctactttgttcgcattataaaaggcacgcgcgggcgcgaggcccttctctcgccaggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagttttatttgcaaaacaaggaaataaaggcttacttctttaaaaagtaaaaaaaaaaaaaaaaaaaaaaaaa

SEQ ID NO: 582 - DNA, 2108 bp, Human
atactcacttccgcccgcgagccacttcctttcctttcagcggagcgcggcggcaagatggcagtgcaaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagttcagaagaggtttggctttccagagggcagtgtagagctttatgctgaaaaggtggccactagaggtctgtgtgccattgcccaggcagagtctctgcgttacaaactcctaggagggcttgctgtgcggagggcctgctatggtgtgctgcggttcatcatggagagtggggccaaaggctgcgaggttgtggtgtctgggaaactccgaggacagagggctaaatccatgaagtttgtggatggcctgatgatccacagcggagaccctgttaactactacgttgacactgctgtgcgccacgtgttgctcagacagggtgtgctgggcatcaaggtgaagatcatgctgccctgggacccaactggtaagattggccctaagaagcccctgcctgaccacgtgagcattgtggaacccaaagatgagatactgcccaccacccccatctcagaacagaagggtgggaagccagagccgcctgccatgccccagccagtccccacagcataacagggtctccttggcagctgtattctggagtctggatgttgctctctaaagacctttaataaaattttgtacaaagacacaaggtctgactagactgttcagtattcagactgaggggcatgttggcctctggagcattacatatcttcttggttttaaccatacttgtggtatttgcaagggccagaacagtaagacccaagcagagccaaccagagaaataatatttgtgtgatagagaaggctgatagcaagcaaggcagcaccttgattcgttgtcctgtagttcaggattgtaggtttagaagagggatatgtttgagtttttcctatgcataaggcgatccacgttgcacatagaaagtgaatataaatggccattatattttgtgtcatgctgtgctctaagtgttctttacatatgtactcgttaatcaacctctctaaagtgtaaaggaaatttgcttgcaccactgaaggcacataaggctcagaagtaaatttgcctaagcagtataaagctatcattagaatccacattcctaagttgtgttctcttaggggatcatggaaccagtcattggtactacaggctattatgttctggagaactgtgaagaacatttaaattgtctctgattttatctatcaatgttttgaagtattttctaccagtgtctgtacttcacaagaaattcggcactattttttcaggcaaaactagtgagggacaggttggcttgaaaatcatgagactgttgttaaatcagatgctggttgatcacagaggggacttccagggaaagctgttatcaggtggctgcttcctggtgatgcagcctggctgatgagataaccctggctccacagatggcttagcaggtgctgtgatgatttggttttcttctcaattagactgagctgcacatggtgtttatattgcttggcacatggtaagggcttaatatttgaggtaattatgtagggcgtacactgacaagtatctgacccccccttcctttttgactcataaattggtcatcttaaccatttaagtgtacacttctatagtgacagagttagccctctgtccaagggatttgcatctgtggattcaaccaactttgggtcaaaaataatcaaaaaggatggttgtgtgtgtattgaacatgtagacttatttttcttattttcaaaatactatattttcttgtcacttattttcttgtacactgcagttgtaacagctatgtagcatgtacattaggtattaaaagtaatccagtgaagattgaaagtctaaaaaaaaaaaaaaaaaa

SEQ ID NO: 583 - DNA, 4340 bp, Human
gcagtcgccggcggttgcctcgcggggttgcggcgagcccggcccgcgaacgtcacgtccctgcgcgctccctgcactctcccgagctgcgctaggcgggcgccacggctgcccggcgaaggaaaccgaaaccgagtccgggcccgtccctccgcggccccatccgcccggtgcacccggggccgcgctcgccaggccgcggagcccagagctgcgcgcacgaaccgtgcgccgggagggcgtgggcgtggcgccgaagggtcccgggtcttcgacgcctctgcggcggctcctccctccttgcagttggatccctggcgggtgcggcccggcccggcccgtgagcggcgcacagaatgggccgatgctgcttctacacggcggggacgttgtccctgctcctgctggtgaccagcgtcacgctgctggtggcccgggtcttccagaaggctgtagaccagagtatcgagaagaaaattgtgttaaggaatggtactgaggcatttgactcctgggagaagccccctctgcctgtgtatactcagttctatttcttcaatgtcaccaatccagaggagatcctcagaggggagacccctcgggtggaagaagtggggccatacacctacaggtcacttgactggtggataacagacaagtgcaatatgattaatggaacagatggagattcttttcacccactaataaccaaagatgaggtcctttatgtcttcccatctgacttttgcaggtcagtgtatattactttcagtgactatgagagtgtacagggactgcctgcctttcggtataaagttcctgcagaaatattagccaatacgtcagacaatgccggcttctgtatacctgagggaaactgcctgggctcaggagttctgaatgtcagcatctgcaagaatggtgcacccatcattatgtctttcccacacttttaccaagcagatgagaggtttgtttctgccatagaaggcatgcacccaaatcaggaagaccatgagacatttgtggacattaatcctttgactggaataatcctaaaagcagccaagaggttccaaatcaacatttatgtcaaaaaattagatgactttgttgaaacgggagacattagaaccatggttttcccagtgatgtacctcaatgagagtgttcacattgataaagagacggcgagtcgactgaagtctatgattaacactactttgatcatcaccaacataccctacatcatcatggcgctgggtgtgttctttggtttggtttttacctggcttgcatgcaaaggacagggatccatggatgagggaacagcggatgaaagagcacccctcattcgaacctaaacattgcctttgcttggtgaagaaactgtgtgagctgtcctgacctggacgatgacgtggggaaaccctccacctccttgcaggcttgttgcctgttgaaagaaggaaaaagacacggcgctggcaagtgataggaacattctggccagaggttaaagagcaggctgacatggctggccattaagctttataaaatcatgtgggctctgaaattgttcttttatgtgtctagcaagtatttaataaacccttgtatagtaattttgttgttgttgggtgctggtagctccagaattttgtgaccactattgtgggtaaaatgtctctgcatcacttgttaatgctactggtctaacttcattcagtatgcttcattcaccgaactttgtgctcaaaatgcgtatataccattttatgttgtattcctccatttcacttgcaaaacagaagtaaataagagttcgggacccagggtaaaatggtagcttcatccaatatatcattcaaatgcatctgatttctaaaacatattacattttatgctgatcttcagttcataattcttccaggaaaactcagtcttccaactgcaataaaatactgggtagaatcaaatgggaaaggggttgggtggggcaatacccatgagttgatagtgataagctcctaaggatttttaacttgtacttttgtgaacgaagagaatgcataaataatgttggtgaggataaagtacagatatttcatgtagaattaattgctagttatgatgcttgtggatagttaactgttttttttttagtcaaaatgatcatgctacgaaaagatgcttctgagagaatgtaatgagtaactgatttttcttcctgagtcgcccttgccaaatatgttactgtattaattaatctaatattgagtgattatttgtaaaattatgaatatgggaaatccatctatctacagcctaagttacacataagtttcagaaagtctgattagactaaagagatatttcttctgggacagccgccttcttggtaattttgaagttctttttacaagttccttcctcagtttcagttctttccagtgttttgtagctcactgtcactcactgaatagagaaacgtgtgccctatacttcctgtgacaatcattttgctgacagaatgatggatgtttaaaatattgcacaaagtactttaaagaaaggtctgttaggaccagaagcagagacaccacttttcaaaggacttcttggtttcagcataacctaagacagggaattgggagccatcatatgtcacagtgttcagaattcaagcatatttaagggcattttctttgattctcaaagttcagcattcattttgaattgagaagcctatacatttagctgacaaagtgcttatagaatttcttaacaactgaaccattcaaaaggattttttttgtttaaaactggatttcaatgtaagcaaatgaagaaaaaaatatagatttcatttccatagcttcttatccctgtattgaggtaataaattgttttactgacaatttttcctttttctacactaaaacaatatgtgatatatttcccctcttgaagaggcaattcattaaactctcaaattttctatagaatcaagatagaacctttagatactccaactcaccaaaatgtaaaaaaactaacaaaaatatttggtcttcaataatgctaaatatctacatttttagaatttatcaacatttaactagataattgggcatgtcttaattatgcatgtacttatccatactaataaaattgacaatgctagtgcatacttattggtttagtcctattatcaggatataatcatctgtgaggaggatattttaaatactgtaaatgataacagttaatgatatacacatttagactgagttgcacactggcagggagaccaaaaacattacttccatacttgtgtcatgattcttttttttttgagagagtctcactctgtcgccaggctggagtacagtggcatgatctcggctcactgcaacctctgcctcccgggttcaagcaattctcctgcctcagccacccaagtagctgggactacaggtgcgtgccaccacgcccagctaaattttgtatttttagtggagacggggtttcaccatgttggccaggatggtctcaatctcctgaccctgcgatctgcccacctcagcctcccaaagtgctgggattacaggcgtaagccaccgggcctggcctgttttatgattcttaatagttacttggtttaaatcacatttgatactatccttctgaaaagtctgagacagatctacaaactacagtcaaaattatagattaagaggaatgaatgcacctatttggctttaagttgaagatgaattatttctcatgctcattttcttgcggcagttatcttagaaagacccccaaaggctttgtgattgtaagcactgtcatgatcacagaatgcaagcttctggtaccatgatcctcaacttagagaggaagaaaccaagacagagagcttaactcacttctctcagggaaaattaggagttgagcacaggacaggaaatgggctttgccacttttagctccaggcttttctaaccagacttgatttcctcatgttctagaaagatcactaatggtcaagtggaacaagcactacacgactaacccctattggggtttttaacttaagggaggctaatttttaatttaaactgctcgagatatgagttctgcaaaaggtggtccgcatccttggccctctggacattatcactaaattgcttgtgcctgttaacaagaatactgaccagaatgctcttcatgtagcttatacagttggttcacttcatgcggttcttgacatgtttatttctacccttaatgcaatgaaatgtttcattaataaaaaaccactttatataaaa

SEQ ID NO: 584 - DNA, 2632 bp, Human
agtgggtgggaagagcccccaagagctctgtgcgggattctaggctcccctgtgacagccgcggcaggaagcaggcgggcgctccccggccacaggcctgttgttctcggaagggagaaagctggacatttccccacgtaactcccagctctgggcctagagtgcgtgcatggcgaagtccccggagaactctaccctggaggagattctggggcagtatcaacggagtctccgggaacatgccagcagaagcattcaccaactgacatgtgccctgaaagaaggcgatgtcactattggagaagatgcaccaaatctttcttttagcaccagtgtgggaaatgaggacgccaggacagcctggcccgaattacaacagagccatgctgttaatcagctcaaagatttgttgcgccaacaagcagataaggaaagtgaagtatctccgtcaagaagaagaaaaatgtcccccttgaggtcattagaacatgaggaaaccaatatgcctactatgcacgaccttgttcatactattaatgaccagtctcaatatattcatcatttagaggcagaagttaagttctgcaaggaggaactctctggaatgaaaaataaaatacaagtagttgtgcttgaaaacgaagggctccagcaacagctaaaatctcaaagacaagaggagacactgagggaacaaacacttctggatgcatccggaaacatgcacaattcttggattacaacaggtgaagattctggggtgggcgaaacctccaaaagaccattttcccatgacaatgcagattttggcaaagctgcatctgctggtgagcagctagaactggagaagctaaaacttacttatgaggaaaagtgtgaaattgaggaatcccaattgaagtttttgaggaacgacttagctgaatatcagagaacttgtgaagatcttaaagagcaactaaagcataaagaatttcttctggctgctaatacttgtaaccgtgttggtggtctttgtttgaaatgtgctcagcatgaagctgttctttcccaaacccatactaatgttcatatgcagaccatcgaaagactggttaaagaaagagatgacttgatgtctgcactagtttccgtaaggagcagcttggcagatacgcagcaaagagaagcaagtgcttatgaacaggtgaaacaagttttgcaaatatctgaggaagccaattttgaaaaaaccaaggctttaatccagtgtgaccagttgaggaaggagctggagaggcaggcggagcgacttgaaaaagaacttgcatctcagcaagagaaaagggccattgagaaagacatgatgaaaaaggaaataacgaaagaaagggagtacatgggatcaaagatgttgatcttgtctcagaatattgcccaactggaggcccaggtggaaaaggttacaaaggaaaagatttcagctattaatcaactggaggaaattcaaagccagctggcttctcgggaaatggatgtcacaaaggtgtgtggagaaatgcgctatcagctgaataaaaccaacatggagaaggatgaggcagaaaaggagcacagagagttcagagcaaaaactaacagggatcttgaaattaaagatcaggaaatagagaaattgagaatagaactggatgaaagcaaacaacacttggaacaggagcagcagaaggcagccctggccagagaggagtgcctgagactaacagaactgctgggcgaatctgagcaccaactgcacctcaccagacaggaaaaagatagcattcagcagagctttagcaaggaagcaaaggcccaagcccttcaggcccagcaaagagagcaggagctgacacagaagatacagcaaatggaggcccagcatgacaaaactgaaaatgaacagtatttgttgctgacctcccagaatacatttttgacaaagttaaaggaagaatgctgtacattagccaagaaactggaacaaatctctcaaaaaaccagatctgaaatagctcaactcagtcaagaaaaaaggtatacatatgataaattgggaaagttacagagaagaaatgaagaattggaggaacagtgtgtccagcatgggagagtacatgagacgatgaagcaaaggctaaggcagctggataagcacagccaggccacagcccagcagctggtgcagctcctcagcaagcagaaccagcttctcctggagaggcagagcctgtcggaagaggtggaccggctgcggacccagttacccagcatgccacaatctgattgctgacctggatggaacagagtgaaataaatgatttacaaagagatatttacattcatctggtttagacttaatatgccacaacgcaccacgaccttcccagggtgacaccgcctcagcctgcagtggggctggtcctcatcaacgcgggcgctgtccccgcacgcagtcgggctggagctggagtctgactctagctgagcagagctcctggtgtatgttttcagaaatggcttgaagttatgtgtttaaatctgctcattcgtatgctaggttatacatatgattttcaataaatgaactttttaaagaaaaaaaaaaaaaaaa

SEQ ID NO: 585 - DNA, 1247 bp, Human
actttacgcaggcgcgttaggtcctagtcgctatgcgtgtgcttgtgggtggcgggacaggcttcattgggacagccctaacccagctgctgaatgccagaggccacgaagtgacgttggtctcccgaaagcccgggcccggccggatcacgtgggatgagctcgctgcatcggggctgccgagctgcgatgccgccgtcaacctggccggagagaacatcctcaaccctctccgaagatggaatgaaaccttccaaaaagaggtaatcggcagccgcctagagaccacccaattgctggctaaagccatcaccaaagccccacaaccccccaaggcctgggtcttagtcacaggtgtagcttactaccagcccagtctgactgcggagtatgatgaagacagcccaggaggggactttgactttttctccaacctcgtaaccaaatgggaagctgcagccaggcttcctggagattctacacgccaggtggtggtgcgctcaggggttgtgctgggccgtgggggtggtgccatgggccacatgctgctgccctttcgcctgggcctggggggccccatcggctcaggccaccaattcttcccctggatacacatcggggacctggcaggaatcctgacccatgcccttgaagcaaaccacgtgcacggggtcctgaatggagtggctccatcctccgccactaatgctgagtttgcccagaccttgggtgctgccctgggccgccgagccttcatccctctccccagcgctgtggtgcaagctgtctttgggcgacagcgtgccatcatgctgctggagggccagaaggtgatcccacagcgaacactggccactggctaccagtattccttcccagagctaggggctgccttaaaggaaattgtagcctaagtaggtcgtggcaagggcctgaggcctgttcctcacaggcttccaggttaggcactgtgaataggctcagctcctctagagagctgaagccatctggttcttagattcctctcccagtcctctttcccattgttctgttgctccaccttattgtctcaaggccgtaatctcatcaggttgggacattaatcttttcaactccttgtaagatttcccagtttggtttctctacatgtcctgcagctgccccacttctcctttacgctgtgtagagaatgctctgcagtttaggcaataaaaataaattgtctcactaaaaaaaaaaaaaaaaaa

SEQ ID NO: 586 - DNA, 1620 bp, Human
gaccattcagaagactgtccacccgtcctcagccccctctcttcgtgggctatctactcagttgatccctccctcgctggcttggctctgactcctgctcagacccatcacctttgccgggaatgatgtctggagaacccctgcacgtgaagacccccatccgtgacagcatggccctgtccaaaatggccggcaccagcgtctacctcaagatggacagtgcccagccctccggctccttcaagatccggggcattgggcacttctgcaagaggtgggccaagcaaggctgtgcacattttgtctgctcctcggcgggcaacgcaggcatggcggctgcatatgcggccaggcaactcggcgtccccgccaccatcgtggtgcccagcaccacacctgctctcaccattgagcgcctcaagaatgaaggtgccacagtcaaggtggtgggtgagttattggatgaagccttcgagctggccaaggccctagcgaagaacaacccgggttgggtctacattcccccctttgatgaccccctcatctgggaaggccacgcttccatcgtgaaagagctgaaggagacactgtgggaaaagccgggggccatcgcgctgtcagtgggcggcgggggcctgctgtgtggagtggtccaggggctgcaggaggtgggctggggggacgtgcctgtcatcgccatggagacttttggtgcccacagcttccacgctgccaccaccgcaggcaaacttgtctccctgcccaagatcaccagtgttgccaaggccctgggcgtgaagactgtgggggctcaggccctgaagctgtttcaggaacaccccattttctctgaagttatctcggaccaggaggctgtggccgccattgagaagttcgtggatgatgagaagatcctggtggagcccgcctgcggggcagccctggccgctgtctatagccacgtgatccagaagctccaactggaggggaatctccgaaccccgctgccatccctcgtggtcatcgtctgcgggggcagcaacatcagcctggcccagctgcgggcgctcaaggaacagctgggcatgacaaataggttgcccaagtgaggacggaccccttaccgatctgtgctctcctagcccaagagacccctggaggggctggagttttatccagcgcctcgtcgtatgtttggctgagcacctgtggcctgggtgcaggttaacttcttgttatcaggagcccactatgcagaggccaaaggtcggcagccagcgaggctatgaattggacctttttggtatctgtgtgactgctctgtgcccatccttagccaacttgctggcgtgacaagtgcccacaagtaacacaccaggtacccagagcagggtggacaggagagacctgaatcacagcagtgaggaattcctcaaagctgtgacctcgcccctgaacttgttcccagtgaaggtcaacagggccaccaaccagggttgaggaaccatctcagccatcctcccaggaagcccacccctgacccttactaatttttctaatgtgcaaactttttcattgaaaaataaaatatatttatgaaacaaaaaaaaaaaaaaaaaa

SEQ ID NO: 587 - DNA, 3927 bp, Human
agatgtcgctcccggaagtgttgggcgcagggcgtggctgcggctgcggctgccacgttggaacggaacgtggaggtggccctggccggggaggaggggcggcggcgaatgctgggagagtccgacgagcgctgcactaacgcaggatccggctgccgaaggtcctcgccagcaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggaagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagcgtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatcctaaaaaaaaaaaaaaaaaa

SEQ ID NO: 588 - DNA, 1510 bp, Human
atccaccgcaggcttactgtacacatgctagggtccaggacagcaggaccaagccagcagaaacagcctgagcccaccgcagactggcctggctatactggacaatgccactcctcctgtacacctgtcttctctggctgcccaccagcggcctctggaccgtccaggccatggatcctaacgctgcttatgtgaacatgagtaaccatcaccggggcctggcttcagccaacgttgactttgccttcagcctgtataagcacctagtggccttgagtcccaaaaagaacattttcatctcccctgtgagcatctccatggccttagctatgctgtccctgggcacctgtggccacacacgggcccagcttctccagggcctgggtttcaacctcactgagaggtctgagactgagatccaccagggtttccagcacctgcaccaactctttgcaaagtcagacaccagcttagaaatgaccatgggcaatgccttgtttcttgatggcagcctggagttgctggagtcattctcagcagacatcaagcactactatgagtcagaggtcttggctatgaatttccaggactgggcaacagccagcagacagatcaacagctatgtcaagaataagacacaggggaaaattgtcgacttgttttcagggctggatagcccagccatcctcgtcctggtcaactatatcttcttcaaaggcacatggacacagccctttgacctggcaagcaccagggaggagaacttctatgtggacgagacaactgtggtgaaggtgcccatgatgttgcagtcgagcaccatcagttaccttcatgacgcggagctcccctgccagctggtgcagatgaactacgtgggcaatgggactgtcttcttcatccttccggacaaggggaagatgaacacagtcatcgctgcactgagccgggacacgattaacaggtggtccgcaggcctgaccagcagccaggtggacctgtacattccaaaggtcaccatctctggagtctatgacctcggagatgtgctggaggaaatgggcattgcagacttgttcaccaaccaggcaaatttctcacgcatcacccaggacgcccagctgaagtcatcaaaggtggtccataaagctgtgctgcaactcaatgaggagggtgtggacacagctggctccactggggtcaccctaaacctgacgtccaagcctatcatcttgcgtttcaaccagcccttcatcatcatgatcttcgaccacttcacctggagcagccttttcctggcgagggttatgaacccagtgtaagagaccacccacccagagcctcagcactgtctgactttgggaaccagggatcccacagaaatgttttggagagcgggaggtttcccccaatctcctccaagttcttctccctccaaccagagttgtgtctaactttaggcatcttttaataaatgtcattgcgactctgaaaaaaaaaaaaaaaaaaa

SEQ ID NO: 589 - DNA, 4454 bp, Human
agaataattttgctgccaagtgaatcagagagacttgcagttctcggagagcacggaacttattcctgcccagagttcagacacagccagaaattaccatttcatacttcacagaatggaggtttcagcagccaaagccccaagtgccgcagacttgtctgagattgaaataaagaaagagatgaagaaagaccctctcaccaacaaagctccagaaaagcccctgcacgaagtgcccagtggaaactctttgctgtcttctgaaacgattttaagaaccaataagagaggcgagcgacggaggcgccggtgccaggtggcattcagctacctgccccagaatgacgatgaacttgagctgaaagttggcgacatcatagaggtggtaggagaggtagaggaaggatggtgggaaggtgttctcaacgggaagactggaatgtttccttccaacttcatcaaggagctgtcaggggagtcggatgagcttggcatttcccaggatgagcagctatccaagtcaagtttaagggaaaccacaggctccgagagtgatgggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaagactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggggtgacagtccaaagattgacttggccggcagttcgctatctggcatcctggacaaagatctctcggaccgcagcaatgacattgacttagaaggttttgactccgtggtatcatctactgagaaactcagtcatccgaccacaagcagaccaaaagctacagggaggcggcctccgtcccagtccctcacatcttcatccctttcaagccctgatatcttcgactccccaagtcccgaagaggataaggaggaacacatttcacttgcgcacagaggagtggacgcgtcaaagaaaacttccaagactgttaccatatcccaagtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaaacgagagattaaacagttattgtctgagttggatgaagagaagaaaatccggcttcggttgcagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgacttacacagagcaaaattgtgctaaaggcttttctactctgagatctcaatgcgaaatgaaaactcaggcagtttagtccatagtggtactattttgatgatattttccattaataaaatgtaatttcagattattcgtttacaagctttataattttatgattttttaatcgtgttttgtcacagacttccctagtgtttgtactacacgtagtcagaagcgagtgtccttttcttttgcttcaggctaagagctgcctcgctctttgtccccccattaggattctattacatatgcaattgtaggttcaacctgtccctttccctgccagcaaaccccaccaccctaagagaaattttagcttatatatgacggtatatttacaaaaagagaaagagaaaatctggtatttgcaatgatctgtgccttctttttaccaccctcttgattggagcttttgtgatgcagctaccatgattcaaaaaaattaaaaattaaaaaaaaaaaatctgccacttatccaagtccactagaggccactgtcttcaaagcttctctcaccctagccaaaggtcctaagaggagacagctgtgaagttgggcgtgctctgtggtaccagctgtgacttttctatttctcctagttttaggttgttcatgaaactagaaatgtcatcctgcttgatttttcatcagccaagttaaacccctgctttctgtcctttgcaccttttgcgtgaacagaatatgcattattaaagcaaaaataaataaaagtaaaatgcaaatgaaaacaagggagggaaagttgtattatttcctgcactgggttacccgtgtgtgttatcgtttaaactgtattcacataatgtcatttgccttgctcacttgtaaccccttcctcaggtccaagagaatgggaggagggtcatgttgaagtgtagccactggaactttcttgcatttatggagttgctttttctttcccaaggaaactgatgtttgcctgtccgctttatctttgtagtacatgaacagttcagccttagactatgtaactgttttctcatccttagctgaaaatgaggggcctactgtattgcgagactgttcaggggtaggggtggagggggtggtcccttaatggcccctgaagatgttggatgtgtttctcaaaagctgctttgtctctttcctgagtttaatagtgaaactactaaacattaatagatttgcacagccacaaagaatgagagttgataataccgaagaagtgatgcaaaaacaaaaaatcacattactgatcattgatagtattacaaataaatgtctcttcctttctcttcctcccttcctccccctgccttcctcttaacctatgtgctcatccttgctacttgaggctgttatttccctccgagtatttaaggagcccaaacaccttggtcttcctgggtgggggcataattaagggaagggagtgtataaggaaggaaacctcataccctccattcccatccctggatatattgccttttcagcagcctcgggttcagtgtgcttggggtcaggagtgccaggttcccaagagcagcgtaaaacatccctgtaccccttgacagttataagcatttctgcgttaaacttgaagattccagagattccccacgacctaatgatctaagaatgcagattggattctttgatgttcaaatttctcatttacttatgaaaatccctaattatatagttttatataatgtgtatacagagtaggattgttgatgaaattgagcggttggaacaccctcatggaacactggcaacatggaatgtagagagctgatgtcttccccctcatagaggccattggcttcctttgtataaggagagggagaagtgattctggaaggagaagttggtatgtctagcttcattgcggcccctcgggctacccagcaagaggattctgcatcaaggaactggacgagccgctacccaaactgccaccatctttactctttacaaaatggacccatcgagaatgttgaaaagcttggaagtatcacttttgaaaaaaaaaaaaattattttgcattcagcatggactcgaccaggcatctatggagattatttttttgcttcattttataaagttgtatttagaaaagtcttaagtattgtgctttgtaaagaagatgattaaaatgaaattttgtgagaatagttttgttca

SEQ ID NO: 590 - DNA, 2880 bp, Human
cactgcatgtgtattcgtgagttcgcggttgaacaactgttcctttactctgctccctgtctttgtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccgatcttcagagccaccatgaactaaaaccactggaatgctgtgagtttccttttggttccaagcagaaggaggtctgcatcaatccctaccactataagagagtagaaagccctgtacttcctcctgtgctggttccaagacacagcgaatataatcctcagcacagcctcttagctcagttccgtaacttaggacaaaatgagcctcacatgccactcaacgccacttttccagattctttccagcaacccaacagccacccgtttcctcactctcccaatagcagttacccaaactctcctgggagcagcagcagcacctaccctcactctcccaccagctcagacccaggaagccctttccagatgccagctgatacgcccccacctgcttacctgcctcctgaagaccccatgacccaggatggctctcagccgatggacacaaacatgatggcgcctcccctgccctcagaaatcaacagaggagatgttcaggcggttgcttatgaggaaccaaaacactggtgctctattgtctactatgagctcaacaatcgtgtgggtgaagcgttccatgcctcctccacaagtgtgttggtggatggtttcactgatccttccaacaataagaaccgtttctgccttgggctgctctccaatgttaaccggaattccactattgaaaacaccaggcggcatattggaaaaggagttcatctttattatgttggaggggaggtgtatgccgaatgccttagtgacagtagcatctttgtgcaaagtcggaactgcaactaccatcatggatttcatcctactactgtttgcaagatccctagtgggtgtagtctgaaaatttttaacaaccaagaatttgctcagttattggcacagtctgtgaaccatggatttgagacagtctatgagcttacaaaaatgtgtactatacgtatgagctttgtgaagggctggggagcagaataccaccgccaggatgttactagcaccccctgctggattgagatacatctgcacggccccctccagtggctggataaagttcttactcaaatgggttcacctcataatcctatttcatctgtatcttaaatggccccaggcatctgcctctggaaaactattgagccttgcatgtacttgaaggatggatgagtcagacacgattgagaactgacaaaggagccttgataatacttgacctctgtgaccaactgttggattcagaaatttaaacaaaaaaaaaaaaaaacacacacaccttggtaacatactgttgatatcaagaacctgtttagtttacattgtaacattctattgtaaaatcaactaaaattcagacttttagcaggactttgtgtacagttaaaggagagatggccaagccagggacaaattgtctattagaaaacggtcctaagagattctttggtgtttggcactttaaggtcatcgttgggcagaagtttagcattaatagttgttctgaaacgtgttttatcaggtttagagcccatgttgagtcttcttttcatgggttttcataatattttaaaactatttgtttagcgatggttttgttcgtttaagtaaaggttaatcttgatgatatacataataatctttctaaaattgtatgctgaccatacttgctgtcagaataatgctaggcatatgctttttgctaaatatgtatgtacagagtatttggaagttaagaattgattagactagtgaatttaggagtatttgaggtgggtggggggaagagggaaatgacaactgcaaatgtagactatactgtaaaaattcagtttgttgctttaaagaaacaaactgatacctgaattttgctgtgtttccattttttagagatttttatcatttttttctctctcggcattcttttttctcatactcttcaaaaagcagttctgcagctggttaattcatgtaactgtgagagcaaatgaataattcctgctattctgaaattgcctacatgtttcaataccagttatatggagtgcttgaatttaataagcagtttttacggagtttacagtacagaaataggctttaattttcaagtgaattttttgccaaacttagtaactctgttaaatatttggaggatttaaagaacatcccagtttgaattcatttcaaactttttaaatttttttgtactatgtttggttttattttccttctgttaatcttttgtattcacttatgctctcgtacattgagtacttttattccaaaactagtgggttttctctactggaaattttcaataaacctgtcattattgcttactttgattaaaaa

SEQ ID NO: 591 - DNA, 3614 bp, Human
gctccgggagagttagggctccgagccgagcgcgcggagcagctggggccggggcgcggatgctggaagttcacatcccgtcggtggggcccgaggccgaggggcccaggcagagcccggagaaaagccacatggtgttccgagtggaggtgctgtgcagcgggcgcagacacacggtgccaaggcgctacagcgagttccacgcgctgcacaagcggatcaagaagctgtacaaagtgcccgacttcccctcgaaacgcctgcccaactggaggaccagagggttggaacagcgccggcagggcttggaggcttacatccagggcatcctgtacctgaaccaggaggtgcccaaggagttactggaattcctgagacttcggcacttccccacagaccccaaggctagcaactggggcaccctgagggagttcctgcctggcgacagcagctcccagcagcaccagcggcctgtcctgagcttccatgtggatccctatgtttgcaacccctccccagagtcgctgcccaacgtggtggtgaatggtgtgctccagggcctctacagcttcagcatcagcccagataaagcccagccaaaggcggcctgtcaccctgctcctctgccaccgatgccctgatcagtccagaggcctttggctgcctcctaagaaagtcatgtgcctctgtcctatgaactccatataaggctgggtcctcctttggcctggacccaggacttaattacccagtgcccagttgtgccacattcccactcaaggctcagaacttggctcgcattggtagctggaggtggtagaatttgtatgctcttagagcccaacagccaaggcagggtcaagaagataagtaataaaagaggaagtcagccaggcgcggtggctcatgcctgtaatcccagcactttgggaggccaagatgggtggatcacctgaagtcaggagttcgagaccagcctgaccaccatggagaaaccccgtctctactaaaaatacaaaattagccgggcattgtggtggtgcatgcctgtaatcccagctactcgggaagctgaggtaggagaatctcttttttttttttttttttttttttgagacggagtttcactcttgttgcccaggctggaatgcaatggcacgatctcggctcacggcaacccccgcttcccgggttcaagcaattctcctgcctcagcctctcgagtagctgggattacaggcatccgccaccatgcccggctaatttttgtatttttaatagagatgggtttcaccacgttggccaggctggtcttgtactcctgacgtcaggtgatccacccgcctcggcttcccaaagtgctgggattacgggcgtgagccaccgtgctcggcccaaggcaggagaatctcttgaagccaggaggcggaagttgtggtgagccgagatcgcgccactgcactccagcctgggcaacaagagtgaaactccgtctcaaaataaataaataataaaggaagaagtcagctgggtgcagaggctcatgcctgtaatcccaatactttaggaggccaaggcaggaggatgcttgggtctggaagtttgagaccagccagcgcaacatagtgagacctgtctctaccaaaaaaaaaaaaaaaaaaaaaaaatcaatttagaggtaggctatgaaaaagtacagatacatcccttaacatagactggagggtggtggcaaggggagcaaatgtggaggcccagtagctggcaaagtttagaagcagggggcaaaagctcctgcctgacttttcctgggtagctcctgggtcaaaatttcaggcaggatcccagggaaggggcaggcacccattgccacaggagagttgcaggcatgttgggatgtaggcctaggggaggtgctgcaggctcaagaaccaggcccacacattatatattaaaaaaaaaaaaacccacatttttttttattggtcagtgttggtaggagtttgttacaaaagtgagtccatgggcctgtggaatgtgaggggagtgggtccgctccaccagatgccagcaccggggccagtgcagctcagagccctgtggcggactacagggcctgcacagacggtcactcaaagaaagatgtccctgtgccctactccttggcgatggcaaagggcttctccacctcgatcttgccgcagtctgcgatgatcacatccttcaggggtttatcccggctgtctgtcttggtgctctccaccttccgcaccacctcctggaaaagaaaggtggaagcaggagggcatggtggatcaggaggtccaccgctcaggagaaaggccccagcgtatggctcaggagggctaagacccacaagtgatcaacagcacacaaaactggaggcaccaaaattctaacagactcctggccagagcagggagaatgcagatttgacgagggggtacaggaattttgttcctttgaagtaagacccaggttgggccaagggtgaggaggaggaagagggtgaccagggcatgtggcttctcagggacattgcgttcagctgcactctgtatacctcaggggtgggaccagcacgtcactgagtgaaggaggggagggaggctctggcagttgtgcagccttcctggctgggctctgagggggctggaagaatttagaaccttggaggcatggaggtacagggtttattctggacaggagcactgggctgcatctgtgggttgggtccttttgggaaagggatggacacatggagctcctgccctggggtctgtgttgaatccccggtgaggattgcccagtagtagcccttgcttccacaactcaccatgccctctagaactttgccaaacaccacatgcttgccatctagccaggctgtcttgactgtcgtgatgaagaactgggagccgttggtgtctttgcctgcgttggccatgctcacccagccaggcccgtagtgcttcagtttgaagttctcatcggggaagcgctcaccgtagatgctctttcctgggaaaaaagacagagcaggtcaggggcgctggattgcgccaaaccaagcagacattcggggccaggactgagggggcttaacctgtcctctgtgccaggctaggctggagtggactacaaggacataaaagcagcgtccttcctatcttctggcctcagagccaagccatgctgactgaggccaagtggggcatcaggccaggctgatgtggtgaacagctcacagaaggattactttgagaagatagttttgtggcttttaaataaggcgcatgttatcagctccccttagctatggcccaggcctgccacggagggactttggtggagggaagtgccgtgcaggatgcaggggagtcaacagggtcggaactctccagaaaaggaggactgctgtggctgaccagcctgttttcctatgagcacaaaagacacaggcatagctgcagaggagaaagcagccagagatgtgtggggaggggcagaaaagaggggctgccccttggattctggagagtcaaagcctcttaacaaggaatgaacaggaataaaagacagctgtgagtgtg

SEQ ID NO: 592 - DNA, 4088 bp, Human
cgcctcgcagcagcgagccgcgagcgcccttctccagtcccggcttggaactgaactgtgtgagcacgggtcctggaacccgggcccagaaccggcgagcccaggtctgagcccagagctcagcggtcagcctcgtaggccctgactcggaatcgagccgaggcgctgaggttggagccggagagcgtgagagccgaagagcagggagggcgggccggctgcgcgtccgacgagtcgcagagcaggaccgcggaaggcagggagacggccgcaagcccagggcagagggcagagggcagagagcggcctggctcggcggagagggcgccgcccggccggaaccaagctcgccgcccgggacggcgggccccgtggggcgcggacccagggtggccgtgggtccgcagcgactccccggccgacggcggggggcgtgccccctcccagcccagcctccccaacccggcccgcccgccgcgtcgcgggggcatgtgagcgggaagcctaggctgccagccgcgaggaccgcacggaggaggagcaggagcgcggagccgcgagccccgagccccgagcccggcgcctggctgagtagatgtccatgaggagccccatctctgcccagctggccctggatggcgttggcaccatggtgaactgcaccatcaagtcagaggagaagaaagagccttgccacgaggccccccagggctcagccactgccgctgaacctcagcctggagacccagcccgggcctcccaggatagtgctgacccccaagctccagcccaggggaatttcaggggctcctgggactgtagctctccagagggtaatgggtccccagaacccaagagaccaggagtgtcggaggctgcctctggaagccaggagaagctggacttcaaccgaaatttgaaagaagtggtgccagccatagagaagctgttgtccagtgactggaaggagaggtttctaggaaggaactctatggaagccaaagatgtcaaagggacccaagagagcctagcagagaaggagctccagcttctggtcatgattcaccagctgtccaccctgcgggaccagctcctgacagcccactcggagcagaagaacatggctgccatgctgtttgagaagcagcagcagcagatggagcttgcccggcagcagcaggagcagattgcaaagcagcagcagcagctgattcagcagcagcataagatcaacctccttcagcagcagatccagcaggttaacatgccttatgtcatgatcccagccttccccccaagccaccaacctctgcctgtcacccctgactcccagctggccttacccattcagcccattccctgcaaaccagtggagtatccgctgcagctgctgcacagcccccctgccccagtggtgaagaggcctggggccatggccacccaccaccccctgcaggagccctcccagcccctgaacctcacagccaagcccaaggcccccgagctgcccaacacctccagctccccaagcctgaagatgagcagctgtgtgccccgcccccccagccatggaggccccacgcgggacctgcagtccagccccccgagcctgcctctgggcttccttggtgaaggggacgctgtcaccaaagccatccaggatgctcggcagctgctgcacagccacagtggggccttggatggctcccccaacacccccttccgtaaggacctcatcagcctggactcatccccagccaaggagcggctggaggacggctgtgtgcacccactggaggaagccatgctgagctgcgacatggatggctcccgccacttccccgagtcccgaaacagcagccacatcaagaggcccatgaacgccttcatggtgtgggccaaggatgagcggaggaagatcctgcaagccttcccagacatgcacaactccagcatcagcaagatccttggatctcgctggaagtccatgaccaaccaggagaagcagccctactatgaggaacaggcgcggctgagccggcagcacctggagaagtatcctgactacaagtacaagccgcggcccaagcgcacctgcatcgtggagggcaagcggctgcgcgtgggagagtacaaggccctgatgaggacccggcgtcaggatgcccgccagagctacgtgatccccccgcaggctggccaggtgcagatgagctcctcagatgtcctgtaccctcgggcagcaggcatgccgctggcacagccactggtggagcactatgtccctcgtagcctggaccccaacatgcctgtgatcgtcaacacctgcagcctcagagaggagggtgagggcacagatgacaggcactcggtggctgatggcgagatgtaccggtacagcgaggacgaggactcggagggcgaagagaagagcgatggggagttggtggtgctcacagactgatcccggctgggtgggcctggccccttctcctctggggaagaccttgtcccaactcgatgggcacagccagccaacctaagactatgttggtacttggacttgttcgtgccccagagatgggcaaagctgtgcacttgcagatacattcatgaggggagaggcgccctcccttcctgaggagctgttggcctgggtgggcaggaactgcagtatggccatgggctgagcaggctgagcacctcagcctttagggcttatggccaggggacactgtatgactctcctctcctgcaggtgtctatccacctggggtatggcatctaccgacctgtctccctggggtcacatgctttgtttccattcttgtcctggctggaccagccactgtgggaccaacacccctcccacactcccccagactgctcgtctatcaccaggatcgctttgtactttgtgcaaaagggtctggctgtcccttgctgttttcatctctgccaagcctattgtgcctctggctgctgtatgtgtgcgcgtgcacgtgtgtgtgtttcatctgttcattcactgcacaagatatttattgagtgcccactacgtgccaggcactgttgctgagttcctgtgggtgtgtctctcgatgccactcctgcttctctgggggcctctttctgtgcttctctttgtccccaaattgctacctctttgtcagtctgggtgtctcaggttctgtgtgtccttgtgtgcatttctgtctctctctgtcctcgtctctctgcaaggccctctatttctctctttcttggtgtctgtcctttgccccctgtgccctctggattctctgggtctatgtaggcccctggtctgccctgggctcatcagccttcctgacctcctcctgccctccccttcactccctccctggctctgccagtcggttcccacggagccatttttagctctgatcagcatgggaatgtgcctcggcctccaaggggctttgtcctggtgcccccgcccctggtcccaacctgatcccacgagggagttgggacaggaggattgatggtgctccccttcctgccagcgtcagaggccctggagaggggctgtccatggcagctggtctttattcctccctcatgagcacagggtcgggggggtccccattcttggaagaggttgagaagactcctgggcttcagcctctcccacccagccctgcccctcacctgcctgccctcccctcccccactctatactagggactggatctcagcctctgatcagtttcacaaagtttgttccctaaggaaatcaaatcccattgtcacctaactctgaagatctaaatagcccttggatcagtatgggaaccccaaatcccacagggccagatgtggagtctgtgtctgcccccgtcttctctccatcctcaaagcccccacttctctccaggctgtttctttttttatgactgtaaacatagatagtgctttattttgttaataataagataatgatgagtaacttaaccagcacatttctcctgtttacactcgggggatttttttgttttctgatgacataataaagacagatcatttcagaaaaaaaaaaaaaaaaa

SEQ ID NO: 593 - DNA, 2850 bp, Human
ccctatcccgtcttgctctgcggcgcaggggcaagatggctgctgagaagcaggtcccaggcggcggcggcggcggcggcagtggcggcggcggtggcagtggcggcggcggtagcggcggtggacgtggtgccggaggggaagaaaataaagaaaacgaacgcccttcggccggatcgaaggcaaacaaagaatttggggatagcctgagtttggagattcttcagattattaaggaatcccagcagcagcatggtttacggcatggagattttcagaggtacaggggctactgttcccgtagacaaagacgtcttcgaaaaacactcaacttcaagatgggtaacagacacaaattcacagggaagaaagtgactgaagagcttctgaccgataatagatacttgcttctggttctgatggatgctgaaagagcctggagctacgccatgcagctgaaacaggaagccaacactgaaccccgaaaacggtttcacttgttatctcgcctacgcaaagccgtgaagcatgcagaggaattggaacgcttgtgtgagagcaatcgcgtggatgccaagaccaaattagaggctcaggcttacacagcttacctctcaggaatgctacgttttgaacatcaagaatggaaagctgccattgaggcttttaacaaatgcaaaactatctatgagaagctagccagtgctttcacagaggagcaggctgtgctgtataaccaacgtgtggaagagatttcacccaacatccgctattgtgcatataatattggggaccagtcagccatcaatgaactcatgcagatgagattgaggtctgggggcactgagggtctcttggctgaaaaattggaggctttgatcactcagactcgagccaaacaggcagctaccatgagtgaagtggagtggagagggagaacggttccagtgaagattgacaaagtgcgcattttcttattaggactggctgataacgaagcagctattgtccaggctgaaagcgaagaaactaaggagcgcctgtttgaatcaatgctcagcgagtgtcgggacgccatccaggtggttcgggaggagctcaagccagatcagaaacagagagattatatccttgaaggagagccagggaaggtgtctaatcttcaatacttgcatagctacctgacttacatcaagctatcaacggcaatcaagcgtaatgagaacatggccaaaggtctgcagagggctctgctgcagcagcagccagaggatgacagcaagcgctcaccccggccccaggacctgatccgactctatgacatcatcttacagaatctggtggaattgctccagcttcctggtttagaggaagacaaagccttccagaaagagataggcctcaagactctggtgttcaaagcttacaggtgttttttcattgctcagtcctatgtgctggtgaagaagtggagcgaagcccttgtcctgtatgacagagtcctgaaatatgcaaatgaagtaaattctgatgctggcgccttcaagaacagcctaaaggacctgcctgatgtgcaagagctcatcactcaagtgcggtcagagaagtgctccctgcaggccgcagccatccttgatgcaaacgacgctcatcaaacagagacctcctcctcccaagtcaaggacaataagcctctggttgaacggtttgagacattctgcctggacccttcccttgtcaccaagcaagccaaccttgtgcacttcccaccaggcttccagcccattccctgcaagcctttgttctttgacctggccctcaaccatgtggctttcccaccccttgaggacaagttggaacagaagaccaagagtggcctcactggatacatcaagggcatctttggattcaggagctaaccaggctcttcctcgggggcgggggagattctgactcttaatctgtattgtgagaaaatcccagcaagttccatgatattaaatccaggtctgcattggcccggggcaagagtttaacatcttcggccctgcattcctacatcttgtgtctgtacacgttcttaagcagcgtgtcaggagagcaccctgttgtcttctggtaaatgtgtgcagggtcatcctgtctcctgtacctcctgggaaaggggccgctgctgtctggtgccctgtgagctgtgattgattgcctttggtcagtaatgcgttcaggagtccacaccaggcacagatggggccttgaaacgctttgtcatgcttcttcagtaccatggatttgaaatgaactcatccttgctgtgagcatccaggagcccttgagaagtttatctatgactatgaaactggcaacgtcaccccagaattacggtcagccttattccccttcacctcccagtgaacgctaagaagtttcagacaagcagagagctctatttttagaagaaatatgttacactcagaaatgatgaaaccaaatcttatattaaaaggcaaagatgacggagactgtgcccatttcttatatgccctccctcatgtccagtccccgttctctcctcgggagcctagttgcgtgaagccggtgaggtcaagtgtaacctgacttaccggcaactaggtgaggctgatgccagatacacatgttagaggcactatttttcaggacttcccaatgtgtaatttttagatgccattatattttaatccccttcgttaccccccgtttttccttagtcatcccttttcacttctattataacatcaataatagaagtcacaaaaacaatgtaagaaagcaaggaataaaagtgatttaaacatgtacctgacactt

SEQ ID NO: 594 - DNA, 1123 bp, Human
agcggtcgggtccgggcgcccgcgcagaatcagctgtctgagctgcccaggcggcgggggagcagcgagcgggcttcagcgagccgcaggaggcacaggcctgtcctgggtccccgcaggtctgcgcgtctgttgttcccagcgctctgagaggcctgaaaaggaagagcaacctgtccagaatccccgcaggaaaggaaaaggaggggaaatctcgacatggaaaaactcttcaatgaaaatgaaggaatgccttcgaatcaaggaaagatagacaatgaagaacagccaccgcacgagggaaagccagaagtagcttgtattctggaagacaagaagttagaaaacgagggaaacacagaaaacacgggcaagagagttgaggaaccgttaaaggataaagaaaagccagagagtgcgggaaaggcaaaaggagaaggaaagtcagagaggaagggaaagtcagagatgcagggaggatcaaagacagagggaaagccagagagagggggaagggcagagggtgaaggagagccagacagtgaaagagagccagagagtgagggagagccagaaagtgaaacaagggctgcaggaaagcgcccagctgaggatgatatacccaggaaagccaaaagaaaaaccaacaaggggctggctcagtacctcaagcaatataaggaagccatacatgatatgaatttcagcaatgaggacatgataagagaatttgacaacatggctagggtggaggataaaaggagaaaaagcaaacagaaattgggggcgtttttgtggatgcaaagaaatttacaggaccccttctatcctaggggtccaagggaattcaggggtggctgcagggccccacgaagggacactgaagacattccttatgtgtagtgtccctggcaggcatttgtcaggccatatgttttaaccttatggtaatactttgctttagtcgttcctcctgctaccagtagcgttttgacccacctgccagtgtttgcttgctctatgtttcagtagcagattttcacacatgtgcattgcagagacgtcatgattcgtggaaaaataaagcagcttataatatcaaaaaaaaaaaaaaaaaaaaaaa

SEQ ID NO: 595 - DNA, 4959 bp, Human
cccccacacaccccagccgaggcccggaaggggccaggcgcgcttccgtctccgccggggatgcacggagggcggagctgcggcccgaggacgcgacgcgagcccagttccggcgaggaggccgcgccagtgacagcgatggcggcggagtcggcgctccaagttgtggagaagctgcaggcgcgcctggccgcgaacccggaccctaagaagctattgaaatatttgaagaaactctccaccctgcctattacagtagacattcttgcggagactggggttgggaaaacagtaaatagcttgcgaaaacacgagcatgttggaagctttgccagggacctagtggcccagtggaagaagctggttcctgtggaacgaaatgctgagcctgatgaacaggactttgagaagagcaattcccgaaagcgccctcgggatgccctgcagaaggaggaggagatggagggggactaccaagaaacctggaaagccacggggagccgatcctatagccctgaccacaggcagaagaaacataggaaactctcggagctcgagagacctcacaaagtgtctcacggtcatgagaggagagatgagagaaagaggtgtcacagaatgtcaccaacttactcttcagaccctgagtcttctgattatggccatgttcaatcccctccatcttgtaccagtcctcatcagatgtacgtcgaccactacagatccctggaggaggaccaggagcccattgtttcacaccagaagcctgggaaaggccacagcaatgcctttcaggacagactcggggccagccaagaacgacacctgggtgaaccccatgggaaaggggttgtgagtcaaaacaaggagcacaaatcttcccacaaggacaaacgccccgtggatgccaagagtgatgagaaggcctctgtggtgagcagagagaaatcacacaaggccctctccaaagaggagaaccgaaggccaccctcaggggacaatgcaagggagaaaccgccctctagtggcgtaaagaaagagaaggacagagagggcagcagcctgaagaagaagtgtttgcctccctcagaggccgcttcagacaaccacctgaaaaagccaaagcacagagacccagagaaagccaaattggacaaaagcaagcaaggtctggacagctttgacacaggaaaaggagcaggagacctgttgcccaaggtaaaagagaagggttctaacaacctaaagactccagaagggaaagtcaaaactaatttggatagaaagtcactgggctccctccctaaagttgaggagacagatatggaggatgaattcgagcagccaaccatgtcttttgaatcctacctcagctatgaccagccccggaagaaaaagaaaaagattgtgaaaacttcagccacggcacttggagataaaggacttaaaaaaaatgactctaaaagcactggtaaaaacttggactcagttcagaaattacccaaggtgaacaaaaccaagtcagagaagccggctggagctgatttagccaagctgagaaaggtgcctgatgtgttgccagtgttgccagacctcccgttacccgcgatacaggccaattaccgtccactgccttccctcgagctgatatcctccttccagccaaagcgaaaagcgttctcttcaccccaggaagaagaagaagctggatttactgggcgcagaatgaattccaagatgcaggtgtattctggttccaagtgtgcctatctccctaaaatgatgaccttgcaccagcaatgcatccgagtacttaaaaacaacatcgattcaatctttgaagtgggaggagtcccatactctgttcttgaacccgttttggagaggtgtacacctgatcagctgtatcgcatagaggaatacaatcatgtattaattgaagaaacagatcaattatggaaagttcattgtcaccgagactttaaggaagaaagacccgaagagtatgagtcgtggcgagagatgtacctgcggcttcaggacgcccgagagcagcggctacgagtactaacaaagaatatccagttcgcacatgccaataagcccaaaggccgacaagcaaagatggcctttgtcaactctgtggccaagccacctcgtgacgtccggaggaggcaggaaaagtttggaacgggaggagcagctgtccctgagaaaatcaagatcaagccagccccgtaccccatgggaagcagccatgcttccgccagtagcatcagctttaaccccagccctgaggagccggcctatgatggcccaagcaccagcagtgcccacttggcaccagtggtcagcagcactgtttcctatgatcctaggaaacccactgtgaagaaaattgccccaatgatggccaagacaattaaagctttcaagaacagattctcccgacgataaactgaggacttgccttggaaatggaatctggggaggcaggaatacaaggacagtgggggttggggaatggaattctacaggagactggagtcttgctttgtggatccttttggtctccgagtcctgcagtctgcaggtgctgcccctgggaacctgcgtgccacagccccgcctccctgcctggagcacactttagaattctgaagatgtgaagcctctgtctcactgaggattttaaaggtcaattatacttttgttgttcattagcatctttgtaaactataagacgtagttttaattaataaatattgcccccagattgtatttatattatcccccaggtttgtttttgttttttgtcctctaccacacatttagccttttatcttccaggtccttattaaaatcagatgaaagcctagtgaaagccagtctcctgccccagctcagctctgtgtggactctggtccagacagaggactgggcatctccagagcctgcacagtacctgctgcacgtagggcaaggaatgagcactagaccgcctgtccccaagggagcctcagtggggcgacagggtgctcggcggactccacctcaggccctccccactgttgctgtgcattcctgtgcaggtgcatctctttcttactaactggtatttattaagggaggtgctctgtaggtctggagcctttccctcatcctttttgcgagtccccacctttttgtttttttttttttctttgaggctcactagaggacgcagaaccttgggagattgatttgcacagaactccccacctcccacttttacaatttccagtttctgattgaaaattttagggtttctccccactgcccttccctatctttccttcccctcaacaccatgaaggaaaaacacacacggcagggctttttgtagccctgaaggcaactttagacatttaaaatccagcactttaatctcttgttctctgtgaatcactatgagaagtgaatggttttaaaggctgtaatgctatgttggaaattggtttgttttgccttttattgaaaaggtaagatcatgtgattggaagaacacaactgttggcttgggaagaggactttgctgctgaagtgttttctaccttctgagtgtgtttaaggcaggatttggagggaaggaccagcttagggagagtgtctgagccacagcgtcaggatgggggaaaccacatgggatccatcaagttccagttgaacaggagcaagatcagaacttaggagggcagtgtcagctcccttgttggctgtcaaggaacaccgatctagtagaaacccacttggttgtgacccaggtagaggtagatgccatacatttgagatatgcgtccttaaggaacctgacaagcagactgaagggatggtaagtgtgacagcctgataagttttctcaaagcccaggatacagagccagtgttttctgtaactggagacctcagttaggccaacttcgaattccagagcaacgtaggaagtctattcagcagaaactcgacattgttcagtgtgtattgctgtgcagggtgcctattgtgacaggacacaaatgttactatgttttaatttgctatatttttgaatgggtaaagcattactttacttctcttggttacttgtaccaccattccacccctatccctagcctgccccacaaatctaatattaggaagcctcttaactgaaaccaaatgaacatttgggtcaggtgccagatgtctgctgcctagaatagctttttctaggtgtctaccaccttgaatttatctcttaactgtgtgttcaagtctttgtcattgaaactagtttttcatatcttagattcagttgtgtatgatttaatgtcccttattaggagtctttaggcagggagggaagaaaaaacagatttgttcatagcaatgtcagtatccattttggcacataaagatttttgatgagccctgtttgcatagagccagatgttttcccctcccccaagagtatctacatcagggatgtgacttggtgcgaagagtcaggggaaagaggaaaaacccaatttctaaatgacctccttgcccagcttactaaaatggctgcagagcagacacaggatgaatttgaacctgacacaggatgaatttgaacctttggtctcatttatggaaaaacttgtgcaattttttttctgtgctacactacatacaaatcaccaaattacaaattacccttttgtgatccttggtgtactgagcagtttctttggggctttttctttctgggaagcgggagggaaaggagcaaggtgtcatcctgctcttcatttgtattttggtcccaaaatgtaaatacaattttctatgttacttttttgtggtaactaccgagatgaatattttaattagataagttatatgaaaaggaaaattccatgtctaaataaaaaacaaactccaaaaaaaaaaaaaaaaa

SEQ ID NO: 596 - DNA, 4170 bp, Human
agacgtcgggtcggcgggtggatgaacgcggccctctgtaatggcggagcgtggcggggacgggggcgagagtgaacgattcaacccgggggagctcaggatggcccaacagcaggccttgaggttccgaggtccggctcccccaccaaatgcagtgatgcgaggcccaccacctctgatgcgacctcctccaccttttggtatgatgcgaggccctcctccaccaccacggccgccctttggacgtcctccttttgatcctaatatgccgccaatgcctcctccaggagggatacctccacctatgggccctccacacctccagagaccacctttcatgcctcctcccatgagttccatgcctcctcctccgggtatgatgtttccaccaggaatgcctcctgtgactgctcctggtactccagcactacctcctacggaggagatatgggttgaaaataaaactccagatgggaaggtttattattataatgctcggacacgtgaatctgcatggaccaagccagatggagttaaggttattcagcaatcagaactgacacctatgcttgcagcccaggcacaggttcaggctcaggcccaggcgcaggctcaggcccaggcgcaggctcaggcccaggcacaagctcaggcccaggctcaggctcaggcccaggcccaggcccaggcccaggcccaggcccaagcccaagcccaggcccaggctcaggctcaggcacaagctcaggcccaggcccaggctcaggtccaggcccaggtccaggcacaagtgcaagcacaagcagttggagcttccacccctacgaccagtagcccagcacctgcagtatccacttcaacatcatcatccaccccttcctctaccacttctaccacaacaactgctacttcagttgcgcagacagtatcaacacccacaacacaagatcagaccccaagttctgctgtttcagttgccacgcctacagttagtgtttcaactcctgctcctacagccacacctgtgcaaaccgttccccagccgcaccctcagacgttacctcctgctgttcctcattcagtacctcagccaacaacagcaatacctgcttttccaccagtaatggtacctccgtttcgtgttccccttcctggcatgccaattccacttccaggtgtattgccaggaatggcccctcctatcgtacccatgatacatccccaggttgctattgcagcttcacctgctaccttagctggagcaacagcagtttctgaatggactgaatataaaacagcagatgggaagacatattattataataatagaacattagaatcaacctgggaaaaaccccaagaactaaaggaaaaagaaaagttagaagagaagattaaagagccaattaaagaaccctctgaagagcctctgccaatggagacggaggaggaggatcctaaagaagagcctataaaggagataaaggaggagcccaaagaagaggagatgactgaagaagaaaaggctgcccagaaggcaaagccagttgctactgctcctattcctggtactccatggtgtgtcgtttggactggtgatgagcgggtcttcttttataatcccaccactcgtctttctatgtgggaccgacctgatgatctgattggcagggcagatgttgacaaaattattcaggagccccctcataaaaaaggaatggaggaattgaagaaactaaggcacccaactccgacaatgctgtcgatccaaaagtggcaattctctatgagtgcaattaaagaggaacaagaattaatggaagaaattaatgaagatgagcctgttaaagcaaaaaaacggaagagagacgataataaagacattgactcagagaaagaagctgccatggaagctgaaattaaagctgcccgagaaagggccattgtccctctggaggctcgaatgaagcagttcaaggacatgctgctagagagaggggtgtctgctttttcaacgtgggagaaggagttgcacaagatagtttttgatccccggtacttacttctcaatcctaaagagagaaaacaggtgtttgatcagtatgtaaagaccagggcagaggaagaacgcagggaaaagaaaaataaaataatgcaagccaaggaagatttcaaaaaaatgatggaagaagcaaaatttaatccaagagcaacttttagtgaatttgcagccaagcatgctaaagattcaagattcaaagcaattgaaaagatgaaagaccgagaagccttgtttaatgagtttgtggccgctgctaggaagaaagagaaagaagattcgaagaccagaggtgagaagattaaatcggatttctttgaactattatctaatcatcacttggacagtcagtctcgatggagcaaagtaaaagacaaagtagaaagtgatccacgttacaaagcagtagatagttcatcaatgagagaagaccttttcaaacagtacattgaaaaaatagccaagaatttagactcagaaaaagaaaaggagcttgaaaggcaagcccgcattgaggcaagccttcgagaacgagaaagggaggttcaaaaggcccgttcagaacaaacaaaagaaatagatcgagagagagagcagcacaaacgagaagaagctatccagaatttcaaagctcttctgtctgacatggtacgttcttcagatgtgtcatggtctgatactcgtaggaccctccgaaaagatcaccgctgggaatctggatccttattggaaagagaggagaaagagaagctttttaatgaacacattgaagcacttaccaaaaaaaagagagagcactttaggcaacttctggatgaaacttctgcaattaccttaacatccacgtggaaagaagtaaaaaaaatcattaaggaagatcctcgatgtattaagttctcctccagtgacaggaaaaaacaaagagaatttgaagaatatatcagagacaaatatatcacagccaaagctgacttcaggacgcttttgaaagagaccaaatttataacatatagatccaaaaaattaatccaagaatcagatcagcacctgaaagatgtagaaaaaattttacagaatgacaaacggtatctagtactggactgtgtgccagaggagaggcgtaaactgattgtggcatatgttgatgacctggatcgccggggtccacccccacctcccacagcatcggagcccacgagacgatcaacaaaataattctaaatactcttccataggggcatctattcaaaatgcttgcatgagccaattttcaggtttttacatatatgtgcattagtcaacctattgcgaaaccatctgacaaacagaaggagaagcatttgtgaacagtttctgaacagaacactttggaaatatttatgcttttctttgtgtggcatgactgacatacatactcaaatataggctgtctctagtaaatcttaaaatcttgaagctaaaattcatccttttatgaggtgtggaagtcagtgacttggtgacgttcttcctagcagtgttaatacatgcaagaagtaagagcatttgtggcttgaacttgccagatgcaaataccacagactccaagaaaacccgagttggggtttgttttgttttgattttttttttttaaagcgggtaaaagagaaaacactgaaaattgaattcttatcttccagaggctacaattattataatggacaatacttttacctttgtctctaaagatcagattagttttatttgttcacttacgtgctttgattatcccctctgaattatagaccgagtcttgttgtttagcctaagagaagatttatgtagtaatttcttctcaggtatggaaccacggtcataactaacatgttggccagaatagaaccactggttaaacatattttattcaccattaagtgatctttatcaatattctggattagacaacaaattacctttctgggtgtttcttgtaaactatactcctgtttgaatgttaaactttgttgctaaagtttaattttaagatgtttgaatgttcagtttatgtatttgaactacaataaaccaaccctttttataaaaaaaaaaaaaaaaaaaaaaaaaaaaaaaaa

SEQ ID NO: 597 - DNA, 4882 bp, Human
gaaagaggagccggaagtgtggcgcgcgaggtctaagggcgcgagggaagtggcgggcggggactaaggcggggcgtgcaggtagccggccggccgggggtcgcgggtatggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctgggatggtgtcagcgggccaggccgacagctccagcgaggacacctccagctccagtgatgagacagacgtggaggtaaaggcctctgaaaaaattctccaggtcagagctgcctcagcccctgccaaggggacccctgggaaaggggctaccccagcaccccctgggaaggcaggggctgtagcctcccagaccaaggcagggaagccagaggaggactcagagagcagcagcgaggagtcatctgacagtgaggaggagacgccagctgccaaggccctgcttcaggcgaaggcctcaggaaaaacctctcaggtcggagctgcctcagcccctgccaaggagtcccccaggaaaggagctgccccagcgccccctgggaagacagggcctgcagttgccaaggcccaggcggggaagcgggaggaggactcgcagagcagcagcgaggaatcggacagtgaggaggaggcgcctgctcaggcgaagccttcagggaaggccccccaggtcagagccgcctcggcccctgccaaggagtcccccaggaaaggggctgccccagcacctcctaggaaaacagggcctgcagccgcccaggtccaggtggggaagcaggaggaggactcaagaagcagcagcgaggagtcagacagtgacagagaggcactggcagccatgaatgcagctcaggtgaagcccttggggaaaagcccccaggtgaaacctgcctctaccatgggcatggggcccttggggaaaggcgccggcccagtgccacccgggaaggtggggcctgcaaccccctcagcccaggtggggaagtgggaggaggactcagagagcagtagtgaggagtcatcagacagcagtgatggagaggtgcccacagctgtggccccggctcaggaaaagtccttggggaacatcctccaggccaaacccacctccagtcctgccaaggggccccctcagaaggcagggcctgtagccgtccaggtcaaggctgaaaagcccatggacaactcggagagcagcgaggagtcatcggacagtgcggacagtgaggaggcaccagcagccatgactgcagctcaggcaaaaccagctctgaaaattcctcagaccaaggcctgcccaaagaaaaccaataccactgcatctgccaaggtcgcccctgtgcgagtgggcacccaagccccccggaaagcaggaactgcgacttctccagcaggctcatccccagctgtggctgggggcacccagagaccagcagaggattcttcaagcagtgaggaatcagatagtgaggaagagaagacaggtcttgcagtaaccgtgggacaggcaaagtctgtggggaaaggcctccaggtgaaagcagcctcagtgcctgtcaaggggtccttggggcaagggactgctccagtactccctgggaagacggggcctacagtcacccaggtgaaagctgaaaagcaggaagactctgagagcagtgaggaggaatcagacagtgaggaagcagctgcatctccagcacaggtgaaaacctcagtaaagaaaacccaggccaaagccaacccagctgccgccagagcaccttcagcaaaagggacaatttcagcccctggaaaagttgtcactgcagctgctcaagccaagcagaggtctccatccaaggtgaagccaccagtgagaaacccccagaacagtaccgtcttggcgaggggcccagcatctgtgccatctgtggggaaggccgtggctacagcagctcaggcccagacagggccagaggaggactcagggagcagtgaggaggagtcagacagtgaggaggaggcggagacgctggctcaggtgaagccttcagggaagacccaccagatcagagctgccttggctcctgccaaggagtcccccaggaaaggggctgccccaacacctcctgggaagacagggccttcggctgcccaggcagggaagcaggatgactcagggagcagcagcgaggaatcagacagtgatggggaggcaccggcagctgtgacctctgcccaggtgattaaaccccctctgatttttgtcgaccctaatcgtagtccagctggcccagctgctacacccgcacaagcccaggctgcaagcaccccgaggaaggcccgagcctcggagagcacagccaggagctcctcctccgagagcgaggatgaggacgtgatccccgctacacagtgcttgactcctggcatcagaaccaatgtggtgaccatgcccactgcccacccaagaatagcccccaaagccagcatggctggggccagcagcagcaaggagtccagtcggatatcagatggcaagaaacaggagggaccagccactcaggtgtcaaagaagaacccagcttccctcccactgacccaggctgccctgaaggtcctcgcccagaaagccagtgaggctcagcctcctgttgccaggacccagccttcaagtggggttgacagtgctgtgggaacactccctgcaacaagtccccagagcacctccgtccaggccaaagggaccaacaagctcagaaaacctaagcttcctgaggtccagcaggccaccaaagcccctgagagctcagatgacagtgaggacagcagcgacagttcttcagggagtgaggaagatggtgaagggccccagggggccaagtcagcccacacgctgggtcccaccccctccaggacagagaccctggtggaggagaccgcagcagagtccagcgaggatgatgtggtggcgccatcccagtctctcctctcaggttatatgacccctggactaaccccagccaattcccaggcctcaaaagccactcccaagctagactccagcccctcagtttcctctactctggccgccaaagatgacccagatggcaagcaggaggcaaagccccaacaggcagcaggcatgttgtcccctaaaacaggtggaaaagaggctgcttcaggcaccacacctcagaagtcccggaagcccaagaaaggggctgggaacccccaagcctcaaccctggcgctgcaaagcaacatcacccagtgcctcctgggccaaccctggcccctgaatgaggcccaggtgcaggcctcagtggtgaaggtcctgactgagctgctggaacaggaaagaaagaaggtggtggacaccaccaaggagagcagcaggaagggctgggagagccgcaagcggaagctatcgggagaccagccagctgccaggacccccaggagcaagaagaagaagaagctgggggccggggaaggtggggaggcctctgtttccccagaaaagacctccacgacttccaaggggaaagcaaagagagacaaagcaagtggtgatgtcaaggagaagaaagggaaggggtctcttggctcccaaggggccaaggacgagccagaagaggagcttcagaaggggatggggacggttgaaggtggagatcaaagcaacccaaagagcaagaaggagaagaagaaatccgacaagagaaaaaaagacaaagaaaaaaaagaaaagaagaagaaagcaaaaaaggcctcaaccaaagattctgagtcaccgtcccagaagaaaaagaagaaaaagaagaagacagcagagcagactgtatgacgagcaccagcaccaggcacagggatttcctagccgagcagtggccatccccatgcctctgacctccaccgacctctgcccaccatgggttggaactaaactgttaccttccctcgctccacagaagaagacagccagcttcaggggtccctgtgctggccaagccagtgagcctgcggggaggctggtccaaggagaaagtggaccagctcccatgacctcaccccactcccccaacacaggacgcttcatatagatgtgtacagtatatgtatttttttaagtgacctcctctccttccacagaccccacatgcccaaaggcctcgggacttcccaccaccttgctccacagatccagctaggcctgacctgtgcctcatcccgtgccgctcggtctctggctgatcccgaggctttgtcttcctctcgtcagttcttttggttgtgttttttgttttttttttaataactcaaaaaaaaaataaaagacttggaggaagggtgcaagctcccagtgcaaaaaaaaaaaaaaaaaa

SEQ ID NO: 598 - DNA, 2000 bp, Human
gtatagacgcgccgggtgcctcgtgcgcatgcgcggcaggcccttcgggacgagctggaggcagagcgtgagtacaaagtgatcggcctcggccgcacgtagtagcccccctactccccggccaagtcagggcctccctcttcccgcggagtcgcaaccacgggtagctcgtgtaggtaacggcaggtccaggcctccgcatgagcggagggccccccgcgcgaccttgaatggcccgggcgcgcgcggtcgtgtgggagttgtagtcctccgtccccgtccgcgcggactccgtttcccgtggtgccccgggcggcccgcttccggcgcagttagttacgagtcggcgcacgcggcctcggtccggttgactttgcggagccatggagggcggcttcggctccgatttcgggggctccggcagcgggaagctggacccagggctcataatggagcaggtgaaagtgcagatcgccgtggccaacgcgcaggagctgctgcagaggatgacggacaagtgtttccggaagtgtatagggaaacctgggggctccctggacaactccgagcagaagtgcatcgccatgtgcatggaccgctacatggacgcctggaacaccgtgtctcgcgcctacaactcgcggctgcagcgggaacgagccaacatgtgaccggcgagcgcgggccaccccaccctgttcatttccataaacgtgctttgagaggcggggtccgcatgtacgtactgcctgcccggggcttaggagggtggcaccggtgctgggacacacgggactgtgtcctcgccaccccccgccctgccccctgccagccagtgcagcttggatctcgggggtgtggggccctgtgccttcctgaagtgctggcagcccagtggcacctccttcaggcctttggggtattcccctagtgtgcccaagtcagcctcatattctgggcggacagcttgtctggacttcggagttgggggtggtcagacaccacaggagctgtcacctcctgcggatgggcaaataaattggtggaggacggagagaaacctctttatttccctcctgaggggtctctgggaagaggtgacgcgtgtccctggaaccccagctcggagggtctcagcctcccctgggttgggagaagtccatctttccccttagtgccaccgggctgctgagtcacgaggaatgtgttgctgctgccacccctgccccaaaggctaagggggacagccttccccttgtcagggcttgctttgaccctgcttcgttccaccccgggtcctggtggagcaccaggcaggtggtcctcgctgtgacactgaggtgctgagccagtgagctagggtggaggggctgtgtttattggaacaaagggtggtaccaaaatgcatccccatgacccacagcccccccacacccgtccttgggtagggtacggtggggtggggtgttgggtggcctgctgctcctgttgctttcacgtagagtctcggcctgggcagtcacgtggtggtcactcctggatgtgctgtcctatccagcctctcacagctgccacccgggtatagacacctgggaagtggggccggccacagccatagccccagctagtgaccccagttagcacccaccgtccagagggctccctgcaggccaggggtcccccagcgtcaccctgttggggagagaagaaagggggttcagaggccggtacctcccctacagcagcccttgggtcattggcccctctaggagtgaccctagtgacttcccctgggagccgcattttcactatctggaaaatgggctcaatgcaaaggtggcagacatttatggacacccgccacgtggtcccggagtggaacggtgcctcccactgcagcctctgcctgctctgccgccgaggcccggggatgggatgcggtgggttgcccaataaacggctgtggagtggaaattcctccagagccaaaaaggcaaaaa

SEQ ID NO: 599 - DNA, 5231 bp, Human
aacaagatgagctgatagggttcccaggctgcctggagttacataacccattgtgcttccaggacagctcacaatcttaggatttgccctaacaagcaaactcagaaaactgctgaggaaggcacgggagggtggctgtgcgaggtactgccggggctgagctctcatggaggctctctctgttctctgaagtgcctttggagtttatgtctgcacatggcattggtttttcaattcgggcagcccgtcagggctcagcctctgccaggactctgccacggcaagctcattcggacaaacgcctgtgatgtgtgcaacagcaccgatcttccggaagtcgagatcattagcctgctggaggagcagctgccccattataagttaagagccgacaccatctacggttatgaccacgacgactggctccatacacctctcatttctccagatgccaacattgacctcacaaccgagcaaattgaagagacgttaaaatacttccttttatgtgctgaaagagttggccagatgactaagacatataatgacatagatgctgtcactcggcttcttgaggagaaagagcgggatttagaattggccgctcgcatcggccagtcgttgttgaagaagaacaagaccctaaccgagaggaacgagctgctggaggagcaggtggaacacatcagggaggaggtgtctcagctccggcatgagctgtccatgaaggatgagctgcttcagttctacaccagcgctgcggaggagagtgagcccgagtccgtttgctcaaccccgttgaagaggaatgagtcgtcctcctcagtccagaattactttcatttggattctcttcaaaagaagctgaaagaccttgaagaggagaatgttgtacttcgatccgaggccagccagctgaagacagagaccatcacctatgaggagaaggagcagcagctggtcaatgactgcgtgaaggagctgagggatgccaatgtccagattgctagtatctcagaggaactggccaagaagacggaagatgctgcccgccagcaagaggagatcacacacctgctatcgcaaatagttgatttgcagaaaaaggcaaaagcttgcgcagtggaaaatgaagaacttgtccagcatctgggggctgctaaggatgcccagcggcagctcacagccgagctgcgtgagctggaggacaagtacgcagagtgcatggagatgctgcatgaggcgcaggaggagctgaagaacctccggaacaaaaccatgcccaataccacgtctcggcgctaccactcactgggcctgtttcccatggattccttggcagcagagattgagggaacgatgcgcaaggagctgcagttggaagaggccgagtctccagacatcactcaccagaagcgtgtctttgagacagtaagaaacatcaaccaggttgtcaagcagagatctctgaccccttctcccatgaacatccccggctccaaccagtcctcggccatgaactccctcctgtccagctgcgtcagcaccccccggtccagcttctacggcagcgacataggcaacgtcgtcctcgacaacaagaccaacagcatcattctggaaacagaggcagccgacctgggaaacgatgagcggagtaagaagccggggacgccgggcaccccaggctcccacgacctggagacggcgctgaggcggctgtccctgcgccgggagaactacctctcggagaggaggttctttgaggaggagcaagagaggaagctccaggagctggcggagaagggcgagctgcgcagcggctccctcacacccactgagagcatcatgtccctgggcacgcactcccgcttctccgagttcaccggcttctctggcatgtccttcagcagccgctcctacctgcctgagaagctccagatcgtgaagccgctggaaggttccgccacacttcaccactggcagcagttggcccaacctcaccttgggggcatcctggacccccggcccggtgtggtcaccaagggcttccggacgctggatgttgacctggacgaagtgtactgccttaacgactttgaagaagatgacacaggtgaccacatttctctcccacgcctagctacctccactccagttcagcacccagagacctcagcgcaccatcctgggaagtgcatgtctcagaccaactccaccttcaccttcaccacctgtcgcatcctgcatccttcagatgagctcactcgggtcacaccaagccttaactcagccccaactccagcttgtggcagcaccagccacttgaaatccacgccggtggccacaccatgcactccacggagactgagcctggctgagtccttcactaacacccgtgagtccacgaccaccatgagcacatccctggggctcgtgtggctgttgaaggagcggggcatttctgctgccgtgtacgacccccagagctgggacagggccggccggggctccctcctgcactcctacacgcccaagatggctgtgatcccctctactccgccgaactcgcctatgcagacacccacatcctccccaccctcctttgagttcaagtgcacgagccctccctacgacaatttcctggcttccaagccagccagctccatcctgagggaagtgagagaaaagaacgtccgcagcagcgagagccagaccgacgtgtccgtctccaacctcaacctcgtggacaaagtcaggaggtttggggtggccaaagtggtgaactcagggcgagcccatgtccccaccttgactgaggagcagggacccctcctctgtgggcccccggggccagcaccagcccttgttcccagaggcctggtacctgagggcctgcccctcagatgccccactgtcaccagtgccatcggtgggctgcagctcaatagtggcatccggcggaatcgcagcttccccaccatggtgggatctagcatgcagatgaaagctcctgtgactctcacctcgggcatcttgatgggtgctaagctctccaaacaaactagcttacggtgaggactggaggggggccggttgccctagaggagacccacgttctcctctcttgctcccacctccctctcttccccccacagtgcactccctccctctgcccttctctgtccaccccctcctaagctagacaaatcaacctcgtgcctaatggaggaagtgtggaaactttgtaaaatgtgtacataggacttggagaccttgtgtccgccctgctctttcttccgatcccacaggaagtgcccctgcactgtcatcactctcacgaggacgtcacctgtgctaacctgggggaaggtggggtcctttcttctttccttttgagaagcactgaaactcccaagtgtgttcttatcccatggataggaaaccagtgaattccgtggctggcacaccacgagctgtcacgcggcacgggtcataacacatctgggtgtcatcggacacctcacctcgcccaccctgtaggagcgtaaggagcctccatcctcagccacgtgcagctgacgtggctttcctgatcggagggcttttcttttatgggtggcccagcttcttcaagaccttcactgctctgcctcagtggacagtcgtttcttttttgaggtgtgaccttttgttttcatgccttccccttgaagtcatcctgtgttttgtaatcagctgtcaggccaaatgtctgacccgaaagagaatgtatttacactcatgctgcgttgttcagcagcccctctgtgttctgtgtgatttgttttatttttccttttttttacatatatatgcagggaagtaatggtactggtagtgtatgttttctatgtggttcaaatatgaatttcgaacacaccaagccgctaatgagatagcagcttttttctgggacccagagtcacaaccaaattgatttaagaccggacccaagacacctttaacaataggactgaaaggaaaaaggatagggaaaaagcttattaaagaaatgtgtcaacaccaaatgtagaggggaagaaccacaaccaggcataataccaaaccggttccagggggaaacaaggctttggtattccgctggctccagcgctttttctgaaacccgaggctggccagggtgctgtcaccatgcggtctttgattgcagccattcaatgcccacatgcttttccttcttgtttcagaacagcacatggtcacaacaagatattttctttccctccaaagccttttgtctccttgtgcctctttttatccttaggaaaagatccaggtgcttgtgaaaagaatcatgaatgcaacaagggaggctggtcctgttgctgtcgccgattaagttttaaacttttatttattatttatgtctgccgtattttaaataaacattctcgttccttccagtttcagtcatagtgtgtctgtggcattccagtccaaccatgtgacttatttattctaatttgagggctgcactgtacaccatggtgtcctgtgacaccgtgttccagacatttatggaaggaaaacatcccatataaatgaaactgtcatgctgtgtcctccccggcagcagaagatgtgtccttccattgagtgagggtaaccttatgtccaccaaggatactttgagaaagcccctaaggaacaagcctcagtcccacggtttcagactatttattctctgaacacaagagtattggttaattatgttctcagctctccctgctgttgtatgtgtgcattcactgcaagtaacttatatctttttatttgaatgtattttaaagcagtagatagaataacaaaggaatatgaaaaccatggactgaatggaccattttatgtattcagagagagaagccactcatcattgccagaaataccatgtaaaaattggcagttcagaggttgcaatacttagtatagtaaataaataaacggtcaacattgtgcaaccactaccaaaaagtgtgttgtaatgcatcaaaaatcaacacaattttattcactaatgagtatcaataaaataagttcaaatgatggaaaccacactggtattctgatttgtattttgtttttatcttttcatcaaggagacgatctctttatgtaagacttgaaagtgtttagctctttgcaaaattaaatgaaaggcatatacttca

SEQ ID NO: 600 - DNA, 3572 bp, Human
gagtgtgtgacccagcccttcccccgtggccaagcagagagagtggccttgaggaagccatagcagcaggaccagcatggcctctgctgcctctgtgaccagcctggcagatgaagtcaactgccccatctgtcagggtaccctgagggagccggtcactatcgactgcggccacaacttctgccgggcctgccttacccgctactgtgagataccaggcccagacctggaggagtcccctacttgcccactctgcaaagaacccttccgtcctgggagcttccggcccaactggcagctggctaacgtggtggagaacattgagcgcctccagctggtgtccacactgggtttgggagaggaggatgtctgccaagagcacggagagaagatctacttcttctgtgaggatgatgagatgcagttgtgcgtggtgtgccgggaggctggggagcacgctacccacaccatgcgcttcctggaggatgcagcggctccctatagggaacaaatccataagtgtcttaaatgtctaagaaaagagagagaggagattcaagaaatccagtcaagagaaaataaaaggatgcaagtcctcctgactcaggtgtccaccaagagacaacaggtgatttctgagttcgcacacctgaggaagtttctagaggaacagcagagcatcctcttagcacaattggagagccaggatggggacatcttgaggcaacgggatgaatttgatttgctggttgctggggagatctgccggtttagtgctcttattgaagaactggaggagaagaatgagaggccagcaagggagctcctgacggacatcagaagcactctaataagatgtgaaaccagaaagtgccggaaaccggtggctgtgtcgccagagctgggccagaggattcgggactttccccagcaggccctcccgctgcagagggagatgaagatgtttctggaaaaactatgctttgagttggactatgagccagctcacatttctctagaccctcagacttcccaccccaagctcctcttgtccgaggaccaccagcgagctcagttctcctacaaatggcagaactcaccagacaacccccaacgttttgaccgggccacctgtgttctggcccacactggcatcacaggggggagacacacgtgggtggtgagtatagacctggcccatgggggcagctgcaccgtgggcgtggtgagcgaggatgtgcagcggaagggggagcttcggctgcggccagaggagggggtgtgggctgtgaggctggcttggggcttcgtctcggctctgggctccttccccacacggctgaccctgaaggagcagccccggcaggtgagggtgtctcttgactatgaggtgggctgggtgaccttcaccaacgctgtcacccgagagcccatctacaccttcactgcctccttcactaggaaggtcattcccttctttgggctctggggccgagggtccagtttctccctgagctcctgagaaggagcagttacctactctcctctaagtacaggactcatatcaacccaagtaccatgtggacttgatccctggctgaatcacctggatgacttggaatagaaatgactgctttagaagatgggatggggccgggtggtaagggatagaagagaggactctcaatctactgatcaagtcctttccccaatgcccagtggatggccagggtacctggggactcaggctgctgccagttctgctcaccaccatccgtgcttggcacagaagtagctgcatagaaagggcactggatttgaagtcagaagacctgggttcttgaaccagcctgtcaaccagttgtatgactttaaacaaggcatctcacctcttttcatcttgttttcttccaataatgttagagttcatgtaatcacattctctagaaccatttagtttgtgttaactatgaaccaagcagtgtggtggccactggtgacttgaaaatatagagaaaaaaaaaacctgctctatatctgaaagagctcttgggaagacagagaaacataaagaggaaattacagcacagtgtggtgggtgttacgggaagtccaaccccagcattatgggagttcaggggaaggggcatagcccagcctggaaggagagggtgagtgggggatggctttctgaaaagggtggtctaaaggatgcctatggtcaatagggaaaagaggggaagaagcatcttaagaagaggaaacagcagagaactggctggatgacctgtgactctggagcactgggttgtctccattgtcattatgggcagatgtgtgccatccccagccgacgccactcactgcctccttcctcctggtgttgccacttctgggtgagattaaggtgcagggcctgggggcaggaggacataaggtatagccataaatcataacccagggaccacactcaaccctagggaaattgtcttcctgatcagttgattaccatctgaggtcaagaaatgagatagtgggagcaaatgggtcacaaatagctcagctgtgggctcagaaactgctaggtaaaagaattccagaaggaggccagggcataagttggatgacctatgaactttagtctaaagaattgagactaccgtaattgagactactgtagtgacatctgagaaatgggatggaagagtgaccatgttttattttcttgttcttgtcactattgtattttattttgcataatcatgcccttcactgacagtctccttaacatcatctgtttactctgctcagtgtaaactacaatgctctgtcatctccctactgggtctcctgggaggaggggagccatccagggtgcaaactcaaaggcagagggcacagcgtgcttaggcccaagcttagaattcaattgagaagttctgttgttcatccttacctcagcaggtagaaaagaggtggagatcagaagccagggattagagattgaattgctttccctgggagtgtgcagtatctcattaaaatgttgtatattcaaaaaaatacagacacacacaagtgcctatataatgataaaacatatccaaagcacccaaacctgtgattccagaaaagtagatcctatttttgtttatttttattggctttagctgtgtcttttgaaaggactattatcctctaaaatgtatgtgtatgaagatcctggcttgcagctcgggagctttacacaccttgtgtcactttatcttggtaacgagccaagatcatgcaaccagttcatccatgtctgacccaagagctcttaactgctatgctgcactgcctcattcagagatagatgcctgcatgggtcctggcgattattttaatgctggctacacccccacaggtgacttggattcagaaatacaatttatatttcttctttttaaattgttttattttatttttcttttaatagttatatgtcagtgagaacaatttatatgtcttacactgagaaataaaactgctcataagtgaaaaaaaaaaaaaaaaaaaaaaaaaaaaaa

SEQ ID NO: 601 - DNA, 3547 bp, Human
cagcaacggcggcctccaggcctcaggccccctcaccatcctagaggtcaagatcagctctggctagttctcacaggtctgacccaacaagtagcactgacatttttacgtttgctggatgtacacacggaagtggaggaggaggaggagaaggaggagggcagctccttagctcaagagcaagtggcccaaggcctcagaagactagaaggaagttcctggccattcagcatggtttcccacgggtcctcgccctccctcctggaggccctgagcagcgacttcctggcctgtaaaatctgcctggagcagctgcgggcacccaagacactgccctgcctgcatacctactgccaagactgcctggcacagctggcggatggcggccgcgtccgctgccccgagtgccgcgagacagtgcctgtgccgcccgagggtgtggcctccttcaagaccaacttcttcgtcaatgggctgctggacctggtgaaggcccgggcctgtggagacctgcgtgccgggaagccagcctgtgccctgtgtcccctggtgggtggcaccagcaccggggggccggccacggcccggtgcctggactgtgccgatgacttgtgccaggcctgtgccgacgggcaccgctgcacccgccagacccacacccaccgcgtggtggacctggtgggctacagggccgggtggtatgatgaggaggcccgggagcgccaagcggcccagtgtccccagcaccccggggaggcactgcgcttcctgtgccagccctgctcacagttgctgtgcagagagtgccgcctagacccccacctggaccacccctgcctgcctctggctgaagctgtgcgtgcccggaggccgggcctggagggactgctggccggtgtggacaataacctggtggagctggaggcagcgcggagggtggagaaggaggcgctagcccggctgcgggagcaggcggcccgggtggggactcaggtggaggaggcggctgagggcgtcctccgggccctgctggcccagaagcaggaggtgctggggcagctacgagcccacgtggaggctgccgaagaagctgctcgggagaggctggcggagcttgagggccgggagcaggtggccagggcggcagccgccttcgcccgccgggtactcagcctggggcgagaggccgagatcctctccctggaaggggcgatcgcacagcggctcaggcagctgcagggctgcccctgggcaccaggcccggccccctgcctgctcccacagctggagctccatcctgggctcctggacaagaactgccaccttcttcggctgtcctttgaggagcagcagccccagaaggatggtgggaaagacggagctggtacccagggaggtgaggagagccagagccggagggaggatgagccgaagactgagagacagggtggagtccagccccaggccggagatggagcccagaccccaaaagaggaaaaagcccagacaacccgagaagagggagcccagaccttggaggaggacagggcccagacaccccacgaggatggaggaccccagccccacaggggtggcagacccaacaagaagaaaaagttcaaaggcaggctcaagtcaatttcccgggagcccagcccagccctggggccgaatctggacggctctggcctcctccccagacccatcttttactgcagtttccccacgcggatgcctggagacaagcggtccccccggatcaccgggctctgtcccttcggtccccgggagatcctggtggcggatgagcagaaccgggcactgaaacgcttctccctcaacggcgactacaagggcaccgtgccggtccctgagggctgctccccttgcagcgtggccgccctgcagagcgcggtggccttctccgctagcgcacggctctatctcatcaaccccaacggcgaagtgcagtggcgcagggccctgagcctctcccaggccagccacgcggtggcggcactgcctagcggggaccgcgtggctgtcagcgtggcgggccacgtggaggtgtacaatatggaaggcagcctggccacccggttcattcctggaggcaaggccagccggggcctgcgggcgctggtgtttctgaccaccagcccccaggggcatttcgtggggtcggactggcagcagaatagtgtggtaatctgtgatgggctgggccaggtggttggggagtacaaggggccaggcctgcatggctgccagccgggctccgtgtctgtggataagaagggctacatctttctgacccttcgagaagtcaacaaggtggtgatcctggacccgaaggggtccctccttggagacttcctgacagcctaccacggcctggaaaagccccgggttaccaccatggtggatggcaggtacctggtcgtgtccctcagtaacgggaccatccacatctttcgggtccgttctccggacagttaaaggggctaggactagggtgagagggagtggggagggagagggcaggaaggaggcagagctgtccgtgggaggtggaggccgaggacattttcctgaagggcaggggttggcaacttttcaacatggagtgccaaactgctaacccgtcttctagtgtgtgagaatagggaccaaggtggtggcgtgaccttaactctcagaagcagaggaggcaggtgggtggagggggatgctgggaattcacctgcctcttgctttttgtgggtggctgctgccaccaccgccgctgctatatagtttaggtttctgaggtttgtgagcctgtcctgctttgcattcttcaaaaccattcctgatagagtagccgagggagagtcttggggccaagaagggcccagggtgggtcaggcgtgtgcactgtggaacagagctgagaccccggccccccttggactggcacagggtcctacagagtcagaggaggcctgagatttcgaatgggcagtgaatggcctcttctgccagccacaggcaggatgctccttgatcacggcatcccccggcggtagtacagggtgagcttgcaggagggtctgcaagtgcagacagcagctggggccaaagaggtgttaggttcaaaggctgcgaagagaataggctactggaaaaccaaacccaacagaattcacgtccaaaaatccacattctccatcgcttctcagccttttggctaagattaagtattaaaaaaaaaccaggctctgccaggcgcagtggctcatgcctataatcccggcactttgggagtctgtggcaggaggattgcttgaggccaggagtttgagaccagcctgggcaacatagcgagaccccatctctacaaaagattaaaaattagctgcgtgtagtagcatatgcctttcaacgtagctactcaggaggctgaggtgggaggatcccttgagccgaggagtttgagtctgcagtgagctatgatcgcaccactgcattccagaccccatctcgaaaaaaaaaaaaaaaaaaaaaa

SEQ ID NO: 602 - DNA, 3015 bp, Human
gcggcgggcgagcggagcggcgcgcctgtccggagctcggcggtggcgccggaggaggctgcagcggcggcggcggcgggcccggacgagcgtccggaggtggcggacgaggcgccgggggcccccatgggcgggtgtgtgggcgcccagcacgactcctcgggcagcctcaacgagaactcggagggcaccggagttgctctaggtcgtaaccagcctttgaaaaaggagaaaccaaaatggaaaagcgattatcctatgacagatggacaactacgcagcaagagggatgaattttgggatacagcaccagcttttgaaggccggaaagagatttgggatgccttgaaggctgctgcacatgcttttgagagcaatgatcatgaactggcacaagcaatcattgatggtgcaaacataacattaccacatggtgcacttacagagtgctacgatgaactggggaacagatatcagcttccagtgtattgcttggcaccgccaatcaacatgatagaggaaaagagcgacatagagactctggatattcctgagccaccacccaattctggatatgaatgtcagcttcgtttgcgcctttccacaggcaaagacctcaagcttgtggttcgcagcacagacacagtattccacatgaagagacggttgcatgcagcagagggagtggaaccaggtagtcagcggtggtttttttctggcagacctctcactgacaaaatgaagttcgaagagctgaagatcccaaaggactatgttgtacaggttatagtgagccaacctgtgcagaacccaacaccagtggagaactgaactgagccctgttggccagctcccacatccctctgctcctttttatggttcttgttgtcatttcctactctgcggcgtgaaatctatttcactgctctaaattccctatgaatggatttagttctgaggaattaccagtgaaaaattccatctgtgatggagaccaacaaaaataataaaacacaaagagccaggctttgagactcatgtaattacaatttctaatttgaaaggcagttaagaaatagataaccatttattttagaacactcaacaactatgtaatggctatatttcagtgacttggactgtaaatgaaacattgcatccatgaaggacagcaccaagcacctttttgaatacagaatttttttagaaaaatatatcaaattatataatttccagaaaccataaataatggatataaaacttaacctttttgttttgttttgttttgttttgttttgttttgttttgttttggttaatggaaactgaaaagagcagtatttgaggttgcttctattctggttttttattcttagctcaattaatatttagccataaatgagtagagactggcaaattgtgctttagtgttgctttcctcatccccacatcttgagctccttatttacattcacactaaattttggtgccttccagcacattagtggcaggcacccttctggaacactaggcaataatttcatcaatacagtcaggtctcttgagtttcaacagatactcagttgaaaagtcgctgtcatcttgctgcataagtattttgaaaggtctgtataacgaagccatttttatatccaggcttagaaggtcactactatatagtaccttcattgatctatctattctgcttggaacttttcatagctaagtataacccccaaatgcatggttcctgggtcaggagacaccaaaatcaattatagctgttcccactcaagttaataaagtaaatgatttcctccactttgcatggaggggtgtaaggaaagcctattttatctgtgcctgggagaactgtgcctattttcagtcttttagaggaaatttcaactcaaaatttttaagtgtgaaaggtttactggtgtcacataaacattagcagtgagaccaaataatgaaacattgctttataccttagtgctttccagttcactgttacctctagtcatggtagatgacaattttcctccctcatcttttgtagcaaagaagcaaattaagagccttttgcaagttagattaggggactgaaaaatccagggagataacctgattcttctatactatgactggagtaaagctgccaagagttaggttgaatttggagccttttaaaagttggttccataagtgagaaggggggctaacatgtgaccactgtgcccctgagaatccatgagatggaaaagtacagacaagaaggcacttaacgctgttctcagttggaaaatgtcagccctccacacctgtttggatgtgaagtgcattattaattttaatgacaaaatgaaactgctaattagtttaaatgtaatgtttaaatggtattgaatttcctattgcctgattaaatatatctgtaattgtaacatcatgtttctgagagctttaactacttccttatttttatgcaatcattttaaagattgtggctatatctaatttaaatttgctgatgattgaatctaaattcaagtgaagaccacagcattaatcccaaaggagattttttttatgtttagaggtggagatattagggtaaatcagtatattgctcctgtcatcaaagtttttgttcatttgtgtgccacatcgaatagcagcacttctcaaagtttgtcaactggaaaaaagtgtttaaaactgtttttttcttaagcagatttggtgatgtcatcaatatctatgatatcgattggtaaaaggtctttctttgttgaggatttgagctctctttttaagagtttattttattttaaaggaacatatgctttgaataacaattctctgggcatgtttaactaacctaggtgggaaaaccatggtgctgtttaattgtaaatagattgatataagattggaccagtacttgatgtgtataattttagtatgtagggtttatgtgctttttttaaaaaaaaaaaaaaggttcaatttt

SEQ ID NO: 603 - DNA, 2396 bp, Human
cttccgcctactgtatcatagcagcttagaatcccagctgctggctcgggctgcagttctctcatggctcgcacagggtggaccagccccattcccctatgtgtttctctgctgctgacctgtggctttgctgaggcagggaagctgctggtagtgcccatggatgggagtcactggttcaccatgcagtcggtggtggagaaacttatcctcagggggcatgaggtggttgtagtcatgccagaggtgagttggcaactgggaaaatcactgaattgcacagtgaagacttactcaacctcatacactctggaggatctggaccgggaattcatggatttcgccgatgctcaatggaaagcacaagtacgaagtttgttttctctatttctgagttcatccaatggtttttttaacttatttttttcgcattgcaggagtttgtttaatgaccgaaaattagtagaatacttaaaggagagttcttttgatgcggtgtttcttgatccttttgatgcctgtggcttaattgttgccaaatatttctccctcccctctgtggtcttcgccaggggaatagcttgccactatcttgaagaaggtgcacagtgccctgctcctctttcctatgtccccagaattctcttagggttctcagatgccatgactttcaaggagagagtacggaaccacatcatgcacttggaggaacatttattttgccagtatttttccaaaaatgccctagaaatagcctctgaaattctccaaacacctgtcacagcatatgatctctacagccacacatcaatttggttgttgcgaacagactttgttttggactatcccaaacccgtgatgcccaatatgatcttcattggtggtatcaactgccatcagggaaagccattgcctatggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctctggtgtctttgatcaggatgacatgtgccatttttcagaggacgtgcagacaggctggcattctagattacttttcttactctgaaacatggcctgtttgggagtgcgggattcaaaggtggtcccacggctgcccctactgcaaatggcagttttaatcttatcttttggcttctgcagatggttgcaattgatccttaaccaataatggtcagtcctcatctctgtcgtgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattct

SEQ ID NO: 604 - DNA, 2053 bp, Human
ggtgatgctgcagccaagatggcgcccgcggcggccgtggcggcctgagcgtgatgctccgggttctcggcggcggctgtggccttggccggggccttgggtctctcccggtcgtgagcgatcagcgcctctccgccggccgggctagccgggacagagaggagacggccacgaagagaggaggcagtgagcaacaggacgagaccgcggcgtctccagcctcggtaccatggccgggatcatcaagaaacaaatcttgaagcacctctccagatttaccaaaaatttatctcctgacaagataaatctaagtacccttaaaggagaaggtgaactgaagaatttggagttggatgaagaagtactccagaatatgttggatttgccaacatggcttgctatcaacaaagttttttgtaataaagcgtccattaggatcccatggacaaaactgaaaacacatcccatctgtttgtccctggataaagtaataatggaaatgagtacatgtgaagaaccaagaagccctaatggcccatcaccaattgcaactgcttcaggacaaagtgaatacggctttgctgaaaaagtagttgagggaatttctgtttctgtaaattctatagtcatcagaattggagcaaaagccttcaatgcatcatttgaactttctcagcttcggatctatagtgtaaatgcacactgggaacatggagatttgagatttactcgtattcaggatccacagagaggagaggttttgacttttaaagaaataaattggcagatgataagaatagaggcagatgccacccaaagttcacatcttgaaattatgtgtgctcctgttcgattaataaccaaccaatcaaaaatcagagtcacacttaaaagaaggttaaaggactgcaatgtcatagcaacaaagttagttctaatattggatgacttattatgggttttgactgattcccagttgaaagctatggtacaatatgcaaagtctcttagtgaagcaatagaaaaatcaacagaacaaaggaagagtatggctcctgaacctacacagagctctacagtagtcgcatctgcccagcaagtgaagacaacgcaaacttcaaatgctcctgatgtaaatgatgcaattgtgaaactattcaatgattttgatgttaaggaaacctcccatcatttagtgatttctcatctagatctacacatatgtgatgacattcatgctaaagaaaaagagtcaaacagacgtattactggaggggcaatgcaactctcttttacacagctaactatagattattatccttatcataaagcaggagatagttgtaatcattggatgtattttagtgatgcaaccaaaacaaaaaatggatgggccaatgagttattgcatgaatttgagtgcaacgttgaaatgcttaaacaggctgtgaaggatcataatgtaggttcacctcctaaatccccaacacatgcctctccccagcacacacaaacagagaaggactaccctctgaaagggacatgcagaacaccttcagtattatctcaacaatcaaaagctaagctaatgtctagttctgttgtggttagacttgcagatttcaatatataccaggtctctacagcggaacaatgtcgttcttcccccaaaagcatgatttgctgcaataaaaaatccctatatcttccacaagaaatgtcagctgtctatatagaattcacagaatattactatccagatggaaaggattttccaactgccttcctaagcagatgagaaaactcaagatagatgaaggaagacatctgctctgcatctcatagggagtaaaatggcacagttgaaactcaagcattgtcttgtaaatctaaattcattgttttttctccactgtattacactgctcccctttgcccctgtattcaccacggccattgtctgttattgcataatcatagtattccagccatgcccccataattgtttttcttaaataaaatatatcattgaacaagtaaaaaaaaaaaaaaa

SEQ ID NO: 605 - DNA, 7777 bp, Human
agaggggaaaagaacgtcaggagagtgaacgggagcaaataaaacgctgtccattctgactggaagggccagagccgtgtctaagggcgggggccgggaggtggcccgcggtggtgtctctaccaggacgaggcctggggtatctgaagaggggatgacgtccaggcgctttgctaaagggaagccagaagggtatgagttgctagggtcagagatggggctttcggctcgagtctttccctgcagggcagagagtccgaagagcccgagaaggcagggaggacagtgggcctggtccttccccggccggcagagggagtcccgagatggaacgtccagctctcctctaacgaaaagcgtttgcatggctgtctcgccaattctgtacctcccggggctgaggaagagccgaggtgactagaagctagcgacaagtgccggccacctccgacgccaggcgccgggcttggagcccgacgggccgaattctcgcgagagcggccgccgccatttttccattgattgcagcgggctgggggaggggccgacgacgaaggcggctgtggtagcggcggcggcggcggcggagccctgggtcggtgtctgcgcgctggtgtctgaggcccaggctgaggcctccgctattgctggagcgcaggcggcggagaggatgactgccgctgccattctctcttgagctagcgagccgccgccaccctccaccctcccccggcagggcggagaggagcggccggagtcagcgatggtgcccggcgaggagaaccaactggtcccgaaagaggcaccactggatcataccagtgacaagtcacttctcgacgctaattttgagccaggaaagaagaactttctgcatttgacagataaagatggtgaacaacctcaaatactgctggaggattccagtgctggggaagacagtgttcatgacaggtttataggtccgcttccaagagaaggttctgggggttctaccagtgattatgtcagccaaagctactcctactcatctattttgaataaatcagaaactggatatgtgggactagtaaaccaagcaatgacttgctatttgaatagccttttgcaaacactttttatgactcctgaatttaggaatgcattatataagtgggaatttgaagaatctgaagaagatccagtgacaagtattccataccaacttcaaaggctttttgttttgttacaaaccagcaaaaagagagcaattgaaaccacagatgttacaaggagctttggatgggatagtagtgaggcttggcagcagcatgatgtacaagaactatgcagagtcatgtttgatgctttggaacagaaatggaagcaaacagaacaggctgatcttataaatgagctatatcaaggcaagctgaaggactacgtgagatgtctggaatgtggttatgagggctggcgaatcgacacatatcttgatattccattggtcatccgaccttatgggtccagccaagcatttgctagtgtggaagaagcattgcatgcatttattcagccagagattctggatggcccaaatcagtatttttgtgaacgttgtaagaagaagtgtgatgcacggaagggccttcggtttttgcattttccttatctgctgaccttacagctgaaaagattcgattttgattatacaaccatgcataggattaaactgaatgatcgaatgacatttcccgaggaactagatatgagtacttttattgatgttgaagatgagaaatctcctcagactgaaagttgcactgacagtggagcagaaaatgaaggtagttgtcacagtgatcagatgagcaacgatttctccaatgatgatggtgttgatgaaggaatctgtcttgaaaccaatagtggaactgaaaagatctcaaaatctggacttgaaaagaattccttgatctatgaacttttctctgttatggttcattctgggagcgctgctggtggtcattattatgcatgtataaagtcattcagtgatgagcagtggtacagcttcaatgatcaacatgtcagcaggataacacaagaggacattaagaaaacacatggtggatcttcaggaagcagaggatattattctagtgctttcgcaagttccacaaatgcatatatgctgatctatagactgaaggatccagccagaaatgcaaaatttctagaagtggatgaatacccagaacatattaaaaacttggtgcagaaagagagagagttggaagaacaagaaaagagacaacgagaaattgagcgcaatacatgcaagataaaattattctgtttgcatcctacaaaacaagtaatgatggaaaataaattggaggttcataaggataagacattaaaggaagcagtagaaatggcttataagatgatggatttagaagaggtaatacccctggattgctgtcgccttgttaaatatgatgagtttcatgattatctagaacggtcatatgaaggagaagaagatacaccaatggggcttctactaggtggcgtcaagtcaacatatatgtttgatctgctgttggagacgagaaagcctgatcaggttttccaatcttataaacctggagaagtgatggtgaaagttcatgttgttgatctaaaggcagaatctgtagctgctcctataactgttcgtgcttacttaaatcagacagttacagaattcaaacaactgatttcaaaggccatccatttacctgctgaaacaatgagaatagtgctggaacgctgctacaatgatttgcgtcttctcagtgtctccagtaaaaccctgaaagctgaaggattttttagaagtaacaaggtgtttgttgaaagctccgagactttggattaccagatggcctttgcagactctcatttatggaaactcctggatcggcatgcaaatacaatcagattatttgttttgctacctgaacaatccccagtatcttattccaaaaggacagcataccagaaagctggaggcgattctggtaatgtggatgatgactgtgaaagagtcaaaggacctgtaggaagcctaaagtctgtggaagctattctagaagaaagcactgaaaaactcaaaagcttgtcactgcagcaacagcaggatggagataatggggacagcagcaaaagtactgagacaagtgactttgaaaacatcgaatcacctctcaatgagagggactcttcagcatcagtggataatagagaacttgaacagcatattcagacttctgatccagaaaattttcagtctgaagaacgatcagactcagatgtgaataatgacaggagtacaagttcagtggacagtgatattcttagctccagtcatagcagtgatactttgtgcaatgcagacaatgctcagatccctttggctaatggacttgactctcacagtatcacaagtagtagaagaacgaaagcaaatgaagggaaaaaagaaacatgggatacagcagaagaagactctggaactgatagtgaatatgatgagagtggcaagagtaggggagaaatgcagtacatgtatttcaaagctgaaccttatgctgcagatgaaggttctggggaaggacataaatggttgatggtgcatgttgataaaagaattactctggcagctttcaaacaacatttagagccctttgttggagttttgtcctctcacttcaaggtctttcgagtgtatgccagcaatcaagagtttgagagcgtccggctgaatgagacactttcatcattttctgatgacaataagattacaattagactggggagagcacttaaaaaaggagaatacagagttaaagtataccagcttttggtcaatgaacaagagccatgcaagtttctgctagatgctgtgtttgctaaaggaatgactgtacggcaatcaaaagaggaattaattcctcagctcagggagcaatgtggtttagagctcagtattgacaggtttcgtctaaggaaaaaaacatggaagaatcctggcactgtctttttggattatcatatttatgaagaagatattaatatttccagcaactgggaggttttccttgaagttcttgatggggtagagaagatgaagtccatgtcacagcttgcagttttgtcaagacggtggaagccttcagagatgaagttggatcccttccaggaggttgtattggaaagcagtagtgtggacgaattgcgagagaagcttagtgaaatcagtgggattcctttggatgatattgaatttgctaagggtagaggaacatttccctgtgatatttctgtccttgatattcatcaggatttagactggaatcctaaagtttctaccctgaatgtctggcctctttatatctgtgatgatggtgcggtcatattttatagggataaaacagaagaattaatggaattgacagatgagcaaagaaatgaactgatgaaaaaagaaagcagtcgactccagaagactggacatcgtgtaacatactcacctcgtaaagagaaagcactaaaaatatatctggatggagcaccaaataaagatctgactcaagactgactctgatagtgtagcattttccctgggggagttttggttttaattagatggttcactaccactgggtagtgccattttggccggacatggttggggtaacccagtgacaccagcactgattggactgccctacaccaatcagaagctcagtgcccaatgggccactgttttgactcggaatcatgttgtgcactatagtcaaatgtactgtaaagtgaaaagggatgtgcaaaaaaataaaaaaaaacaacaaaaaaagctaaccttctattagaaaaggggacaggggaatgagtaaacttcttttattgcggacaaatgtgcacatagccgctagtaaaactagcctcaaacaggatgctcatagcttaataataaaagctgtgcaaaggccatgaatgaatgaattttctgtttatttcactgatgcacacattacctcattgacaattcagaagtaaatccaacgtgtgttgactcttggaaagcagcaaaaacaggagctgaagaaaagaaattcttggaaccagccgtaacccagtaaggaattgtgaagttgtgtttttattttgtttcattttttgcagagtattaagaacattattctggaacatcagaacgtttcccttagaccgatcccagcaggtggcagctcagattgctgcagtgttgtaattataactgattgtacttaagttatggatgtagagaatatgtttcattcatttattcagcatgtaaataaaattgatcctgttgagttatcataattgcagttcaactatctgccatgattattcttttcacgtatcattcattctgtacatttgtgtacattgagaagtatagcaatctatgtaaatgtaatcctcagtgaggttcctcagtgctaggtcccataggattgtcgttgcccttgttaatgaggtttctctgttcagcggcttcaatttttttctctttgtacatctagttttgaagatttacttcaagtttgaatcttctagaatgcttgtaagtccagttttaatttttagagtcaatttgtagttacatgtagtttaacttttgggaaacgtcttaacattgttctgaataaacttgctaatgaggtcaggtcatggtacagactgatgcagtcaacatgatttcattgcagagtttattagtatcagcaagtttttgctttgctaaataaaagtactcaatgaacacaattctacataaattttgacataccatctaatttataaaaatcaataaaaaaggttttggtaaaactttttcatgccagatgctgtttacaacaatgaacatgccaataaaacatttgttcattctgttgtgttattttagtcattaaacttctgtggatgaagaatctgggttaagaatagatttgtcatctttaaatatgacattttgtaatgtgtattggatatctcatttctatgataaaggtatatttacagtaaagttctcataagagaaatgaaaagctgtgttaatatctaactttggggaaccctgtcagtatttcagatccgatttttaccctttttttcttataagaaagataaaattagaaaatactgttagcaaatgtggctctgccatttgaatataatcaccgagaattccatgtcttaaaagtctcctggaatccacaatgaaaaaaaaaatcttttctaaggtatttttctggctaatttttatttgaagaaagctatagcatttagcgaaatttgactgaagtaatgttctgagtttgcattagtgggattggtgatgttctcagaagaaaattggaaacacttgtgatgaattgtctttcagatcacttagattttctgatgtaagaggacagctgtttggttctgatacaggcctgcttacttgggatgtagggttagtaaatggggtttctgctttaaaggactgacttgctatcacacaaaagaggcagacttgtaaacacaatgggctttggagtttggtctgattgggtttggtttagtattcctatgagcgtaaatggtaaaattcttctgatacccactctttagactgtgccttctgctctgttctttgttttatgtttaactgctgtttctaattgcaggtgtattacagatacaaataagagtaaagaaaatatatttcattatagaaaagaaaaaattaaaagcttcttgcttttcagtgcctgatagagtgaaaacacaaagttgcactttaataatttcaataaaagctaatctgtgtcagcctccctctgcttcagagagtcaggtgagcatccataacctaacaggcagagccctagcgatgtggatcaagtttcctgagcccgggggcggtggagcctcatgatctcttatcttttgaggctgaggcaggtcacatgcaacaaattgtgaccctgctccccacaagtcatgcaaaggttttgaagagcttttaccgtggggcagatgaacttgtgtcaaccatgcacaccctgtgagaaccaagtacctgtgtttctaaggcgggcactcaaggtgaggggtgcattctggccaaagaaacaaaagctgtggtttcaggaccatgccgtgtgtagctgatctgtacgggacgtgtatgtaaggaagagcaatcatgatagataagaacagtgtgtgaagcagccttcacactagagtgtttggtcatctcttataatgtaagggaaggtactttaaaattctgggaagatgcgatgaactcatgtcccagtcagaaaataatccaatgaaataagcattggttgccaggccacagttaggaattgtattgtgatacatctagaggccaagagagcaggagagagctaccaacttacactgtggtttaagctaaatgaccgcacagcatcatagcattgcagtgttgttactaaatctggaagtgacctgtgaatgtatggaatacaataaagtcttttattctggttcatttgctagtacttcctttttgattggatactgtagttcttcctctggattttattttgttcagcgtcaaggccctaattttgcaaatgtagtctaaaccacattacgtggactagaggatactctgaattagcaagttttttgtttgctgaataaaactattccatcttaa

SEQ ID NO: 606 - DNA, 2758 bp, Human
ctcgcccggcgccccgcccctcccgctggatcccgcagccgcggctcttcccgacgcgttccgccttccccagctgtgcactctccatccagctgtgcgctctcgtcgggagtcccagccatgtccgacgagagagaggtagccgaggcagcgaccggggaagacgcctcttcgccgcctccgaaaaccgaggcagcgagcgacccccagcatcccgcggcctccgaaggggccgccgccgccgccgcctcgccgccactgctgcgctgcctagtgctcaccggctttggaggctacgacaaggtgaagctgcagagccggccggcagcgcccccggcccctgggcccggccagctgacgctgcgtctgcgggcctgcgggctcaacttcgcagacctcatggctaggcaggggctgtacgaccgtctcccgcctctgcctgtcactccgggcatggagggcgcgggtgttgtgatcgcagtgggcgagggagtcagcgaccgcaaggcaggagaccgggtgatggtgttgaaccggtcagggatgtggcaggaagaggtgactgtgccctcggtccagaccttcctgattcctgaggccatgacctttgaggaagctgctgccttgctcgtcaattacattacagcctacatggtcctctttgacttcggcaacctacagcctggccacagcgtcttggtacacatggctgcagggggtgtgggtatggctgccgtgcagctgtgccgtacagtggagaatgtgacagtgttcggaacggcctcggccagcaagcacgaggcactgaaggagaatggggtcacacatcccatcgactatcacacgactgactacgtggatgagatcaagaagatttcccctaaaggagtggacattgtcatggaccctctgggtgggtcagatactgccaagggctacaacctcctgaaacccatgggcaaagtcgtcacctatggaatggccaacctgctgacgggccccaaacggaacctgatggccctggcccggacatggtggaatcagttcagcgtgacagctctgcagctgctgcaggccaaccgggctgtgtgtggcttccacctgggctacctggatggtgaggtggagctggtcagtggtgtggtggcccgcctcctggctctgtacaaccagggccacatcaagccccacattgactcagtctggcccttcgagaaggtggctgatgccatgaaacagatgcaggagaagaagaatgtgggcaaggtcctcctggttccagggccagagaaggagaactagggcaagtggctgtgagaccctagagaccagcgaagggagaagttgggaagctacgttctgttggccaccagacttgcatttcagcctctgtcataatgctctgccctccctcccccgaaggtctctgtggtgatgaccgctctcccctgcccctccccgcttcctgacctctgaagaggttgggaagtgaccatttggatgtctgggccctgccaaggcgacagggagggtcagagggaggccggctgcttcctgcccccaccctttccccgggcctgctgtgctgcttttgtgccaaggttagccagtcccccctgttgtgttccatgtgctttcacctctgcctcatctttcctcccgtccctgccccgccacctccccaaagaattgaaacgtcagctcaggatatggggccaatctctgtgagtccagcatgtacctgtctctccctagtgtcccttcagcctgggctgaccagtgcccgcctctgggcttgaccagttcccaatctcgtcctctgtccccaacttcttaagcacaattgggcttcttccatctccaggttttctgccattcttaaccaaggctgcctcttccaacagggcgggaatcagacctactcccctaggtcacaactctgggaaggatacagagcccccacccttcactgagttctctggatttgttctcagtgccttagcaacgaaaacctgtgcttgtgtgtgtgtggcggcggggagggaggatcctgtttcccacctccttctcctcccctgtactccccagtgccttccttgttctggtggagctggggtttctctcctccccagtcccacaacactgccaaaaatctgtgtatgtgccattgggtggggcagccccaagcctcctggggaggcagggcaaaaacaggtgccctcatcgtggtctgtgccatgtcccgtctctatggtggttgaggagaaaggcggggaagcttcctcagccttgcagatatgtgtggcatttactagccagagctctgaaaggcagtgctgtctgtttcttgtactgggaccaaagtaaaaatccaagcacattccccttgcagttaggggaggccctactgccttctcaaagcagagaggcagcttatcaaactcagcccaaaactctgtttacatgggtggggagatggagcagggaagtacagagtgggatggtcaggacctgggccattgcaaccaaaatggggacttcctgggtagggaggtcactccctctactcactgagctaggattagggagggttattgccccaaccattgcaatgggaggtggagggacaggctcagcctcctcattgtctaaatgaggcctaaatgtgtgaagtgcgatttctgcttttgtgtaccccaccaccccattaccacagctgcctttgtgtgtttgtgtcaataaaaagccaaaccctggg

SEQ ID NO: 607 - DNA, 4394 bp, Human
gactcgcccttcggctcaggcacctgcctggccgccccgcgcggcggggtcctgaggcgcctcggggaagcgcggcgattggctgccgctcgcgggtagagctcggctccccggcacttgacaaccgcagtctgcaagaggctgagctgaggagtcgctgggccgggaggggcggacgtgagaaggacggattgacgaactgatggattgacgcgcgggcggtaggagggaggaccgacgccaaacccagaccgccgccgtcgtgctcctgccgcagcccggagccggccgcttcggggccctggccgccggcctcccagccgcgttctcctccgccgctcctccgggcttgccctggagccctcaggctatcaatatgacggctgaagaaacagtgaatgtaaaagaggttgaaatcattaagctaattttggacttcctgaattcaaagaagcttcacattagtatgctggccctggagaaggaaagtggagtcataaatggcctgttttcagatgatatgcttttcctgaggcagctaatacttgatggtcaatgggatgaagttcttcagttcattcagcctctagaatgtatggaaaaatttgacaaaaaaaggtttcgttatattatcctgaagcagaagtttttagaagctttatgtgttaacaacgcgatgtcagcagaagatgagccccagcatgtaagatttttattcctgaagctggaatttaccatgcaagaagctgtgcaatgtttacatgctctagaagaatactgtccttctaaagatgactatagtaagctctgtttgcttttgactttgcctcgtctgaccaatcatgccgagtttaaggactggaatcccagcaccgcacgagttcactgttttgaagaggcttgtgtcatggttgcagaattcatccctgctgataggaagctaagtgaagctggttttaaggctagtaacaatcgtttatttcagcttgtaatgaaaggcctgctttatgaatgctgtgtagaattttgtcagagtaaagcaactggagaagaaattacagaaagcgaagtgcttcttggcatcgacctcttatgtggtaatggttgtgatgatttggatctgagtttactgtcatggcttcagaatcttccatcttctgtcttctcttgtgcttttgaacagaaaatgcttaatattcatgttgacaaacttctgaaacctacaaaagctgcatatgctgatcttttgactcctcttatcagcaaactctctccctatccatcatccccaatgagaagacctcaatcagctgatgcctatatgacccgctctctgaatcctgctttagatggcctcacctgtggactaaccagtcatgataagagaatttcagaccttggaaacaaaacttctccaatgtcacactcctttgctaacttccattatccaggggtacaaaacctcagtagaagtctcatgcttgagaatacagaatgtcacagtatttacgaagaatcccctgagcgaagtgatacacctgttgatgcacagaggcctatcggcagtgaaatcttgggccagagttcagtttcagaaaaagagcctgcaaatggagcacagaatccaggaccagctaaacaagaaaaaaatgagcttcgagattcaacagaacaatttcaagaatattataggcaaagattacgctatcaacagcatttagaacagaaggagcaacagcggcagatataccaacagatgttgcttgaaggaggcgtgaatcaggaggatggtcctgatcagcagcagaatcttactgaacagttccttaataggtccattcaaaagcttggtgaattaaatattggaatggatggccttggtaatgaggtatcagcactcaaccagcaatgtaatgggagcaaaggcaatggatctaatggttcttctgtgactagttttactacaccaccccaagactctagtcagagattaacacatgatgcttcaaatattcatacaagcactcctcgtaatcctggatcaacaaatcacataccttttctggaggaatcaccttgtggaagccaaatctcttcagaacattcggtcattaagccacctcttggagattctccagggagtctttcaaggtcgaaaggggaagaggatgacaaatcaaaaaagcagtttgtttgtattaatatcctagaagacacacaagctgttagagcagtggcttttcatccagctggaggtttatatgctgttggttcaaattcaaaaactctgagagtatgtgcctatccagatgtaattgatccaagtgcacatgagactcctaagcagccggtggtacgttttaaaaggaataaacatcataaaggatccatttactgtgtggcctggagtccttgtgggcagttattagcaacaggatcaaatgacaaatacgtcaaagtgctgcccttcaatgcagagacttgtaacgcaacaggaccagatctggaatttagtatgcatgatggaacaattagagacttggcatttatggaaggcccagaaagcggaggagctattttaataagtgctggagcaggggattgtaacatttatacaaccgattgtcaaagaggacagggcctccatgctttgagtggacatactgggcatattttagcactttatacctggagtggctggatgattgcatctggttcccaagataagactgttagattttgggatcttcgagtaccaagttgtgttcgtgttgttggcacaacatttcatggaactggcagtgcagtggcatctgtagctgtagatcccagtggtcgtctcttagccacaggtcaagaagattctagctgcatgttgtatgacataagaggaggaagaatggtacaaagttatcatcctcattccagtgatgttcgctctgttcgattctcccctggagctcactacttgctaacaggctcttatgatatgaaaataaaggtgacagacctacaaggggacctcaccaagcagcttcctatcatggtggtgggggagcacaaggacaaagtgattcagtgcagatggcacacccaggatctttccttcctgtcatcctctgcagatagaactgtcaccctctggacttacaatgggtagagcacaccgcatgtcagtctatgcagcaaaagcacagagacttaagactactgagttgtgaaaattacaaatctgaagaacatagtgtccaggaaagtggtttagcacgaagaggccccttattaccatgtatcccactgataggaggtgttgggtggtgttattccgcagtgctttcagtcttccatgtgagctcgtgctgctgtgacctgctatatgtagtctcgttgccaaagtctgcagaagagctcttcagttgttggtgtgcactccaagtcaggatggacaatgtgtttacggtttagtattcaatgcattccttggtctttgcctaaataacagttttatatgcacattgaaatggaattatacttcaactatattattaaatgtaatgcaaccaagttcctcccagattaaacttcccaggtgttcagaattacttttgctcttctcacgatcccatattgtattatcacttgtcttctagaggtcagaattccataatatatgtcactcaaaagttacatggttgctttcacttaaggatcattgtggagtttaaagatgaatgaaaaactgcttcttagtttactacatggtataggcccttttttcttaaacccagggatatgattattttgtcatataattttgtttcaggctaaaaggtaaatgtgtttgcttcagaaacttgttaacttcagttttttgaatgcaacaggatacctcccttccaaactgaactgtagaagcagagcagcagcagttatgtgatgcaacacttgatggtacagtaaatttactggcatttttctccttaaaaattaaaatccttgacatagaccatagcatggcttgaaatgctatgtctgcatgataatttaaaatggaagatttaaactttgcactccaaaagcttatttggatttttttcttgcactgttttgtgtaatgcagaataatgattttatttctacagctttgtagattctaacatttatgtatctttattttcatattgtacagtaattttactttaaattatttaaataggctattttatttatttcaaatgcagttgtattagttctcattattgaactgtctgtgcactgtatgtagcaagcatttttcatctgttgtatacaagtggaaagggtattagaagtgtaactgtgctattatttcaataaagacctcttgacatttaaaaaaaaaaaaaaaaaaaaaa

SEQ ID NO: 608 - DNA, 5249 bp, Human
gatggctcttgctcacccgagcctcacaaagataatcgctcaggaagtgtttcagccaatccggggcggctttacactccgatttgccggggcagccaatcggggatgagcttttattaggcggccagatcatcagccgaagtgccaaaccctttttctgtgagaactaggagcctgtcctccatgttttataagtattgacattacacagtgttaacaatgcatccacagagcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcagtcagaactaagacatggtccgttttactatatgaagcagccactcaccacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaactgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacgatttaaaaaaaaaaaaaaaagcaaccaaccccaacaacaaaaaagaatgttttggtattggagaagggatggtcagttagcctgtctgtcacacgacggaatggatactgggcccggggaccactttcatactcacgtcctcatccttggatacccaggggagggcgaaccgttttcgctcgtgtgtctgtacgcagcatgttgggatcgggagtttcggcacagactatcccatcaagccgttggctcctttcagctactacgttaccacgttcctaaaacgcaagctctccggaccagacggacacagggagaagctagtttctttcatgtgattgaaatgatgactctactcctaaaagggaaaaaacaatatccttgtttacagaagagaaacaaacaagccccactcagctcagtcacaggagagaacacagaaagtcttaggatcatgaactctgaaaaaaagagaaaccttatctttgctttgtggttcctttaaacacactcacacacacttggtcagagatgctgtgcttcttggaagcaaggactcaaaggcaaggtgcacgcagaggacgtttgagtctgggatgaagcatgtacgtattatttatatgatggaatttcacgtttttatgtaagcatgaaacacaggcagtatgagagaaagcaaggcccgtcatgctgtccgtacactacgtatgctgtagagccattttgtatgttgtgtaaaacaaaaagcattgatgaaaaagcaaaaggtgatgtatgtatatgagaaaattaattgtacgatatcattccagtacgttttgttgtacattttagtcttgtttactttctcttcattgttaagaggatgcgaactgtacagtttccagctagttacccatattagagaagaaataagagagtattagaagaaaacaggagagaaagaacatttgtgaattgcagttgtcaaaaaaaaaaaatagcctagctggccttatttgtgaagcataattgcttttagcatatggaagtattttttcacattttctttgtataaaatttgtattaaacttaaatatctttttgatggtggtgtttctttgtgactgagccagtagactcacactatatgcttttttgggtttgcccgttccttcccccacccccccagttttttcagatttctttacctttttttaattaaactgttttggaaaaatgc

SEQ ID NO: 609 - DNA, 3861 bp, Human
tttgtctctcgccgcagcctgagctccaggtctccccttcgctgctctgtgtcctctgctcctagaggcccaacatctgtggccctgtgacctgcaggtattgggagacccacagctaagacaccgggaccccctgaaagcctagaaatggacgacttgaaatatggagtgtatcctctcaaggaagcaagtggatgccctggggctgagaggaatcttctagtttactcttattttgaaaaggagacattgacatttagggatgtggccatagaattctctctggaggagtgggaatgcctgaaccctgctcagcagaatttatatatgaatgtgatgttagaaaactacaaaaacctggtcttcttgggtgttgctgtctctaagcaagacccagtcacctgtctggagcaagaaaaagagccctggaatatgaagagacatgagatggtggatgaacccccagctatgtgttcttattttaccaaagacctttggccagagcaagacataaaagattcttttcaacaagtaatactgagaagatatggcaaatgtgaacatgagaatttacagttaagaaaaggctccgcaagtgtagatgagtataaggtgcacaaagaaggttataatgagctaaaccagtgtttgacaactacccagagcaaaatatttccatgtgataaatatgtgaaagtctttcataaatttttaaatgcaaatagacataagacaagacatactggaaagaaacctttcaaatgtaaaaaatgtggcaaatcattttgcatgcttttacacctaagtcaacataaaagaattcatattagagagaattcttaccaatgtgaagaatgtggcaaagcttttaaatggttctcaacccttactagacacaagagaattcatactggagagaaacccttcaaatgtgaagaatgtggcaaagcttttaagcagtcctcaacccttactacacataagataattcatactggggagaaaccatatagatgtgaagaatgtggcaaagccttcaaccggtcctcacaccttactacacataagataattcatactggagagaagccctacaaatgtgaagaatgtggcaaagcttttaaccagtcttcaacccttagtacacataagttcattcatgctggagagaaaccctacaaatgtgaggaatgtgacaaagcttttaatcgattctcataccttactaaacataagataattcatactggagaaaaatcttacaaatgtgaagaatgtggcaaaggctttaattggtcctcaacccttactaaacataaaagaattcatactggagagaaaccctacaaatgtgaagtgtgtggcaaagcctttaatgagtcctcaaaccttactacacataagatgattcatactggagagaaaccctacaaatgtgaagaatgtggcaaagcttttaaccggtccccacaacttactgcacataagataattcatactggagagaaaccttacaaatgtgaagaatgtggcaaagcttttagccagtcatcaatccttactacacataagagaattcacactggagagaaaccctacaaatgtgaagaatgtggcaaagcttttaaccgatcctcaaatcttactaaacataagataattcatacaggagagaaatcttacaaatgtgaagaatgtggtaaagcctttaaccaatcctcaactcttactaaacataggaaaattcatactagacagaaaccctacaactgtgaagaatgtgacaatacatttaaccagtcctcaaaccttattaaacaaaataattcatactggagagaaactctacaaatgtcaagaatgtgggaaagcctttaagcagtcctcaactcttactaagcattaaatattggccgggtgcggtggcttatgcaaaatggctcccagcattttgggaggctgaggtgggtggatcacaaggtcaagagatcgagaccatcctggccaacatggtgaaaccctgtctctactaaaaatacaaaaattatctgggtgtggtggcacgtgcctgtattcccatctactcgggaggcttaggcaggataatcacttgaacctgggaggtggaagttgcagtgagccaagattgtaccactgcactccagtttggcaacagagtgagactccgtctcaaaaaaaatttatactgtacaaaaaccccacaagtgtgaaaaacatggcaaagcctttaagaagccctcaattcttaacagacataagataatttatactggagagaaactctacaaatcagaaagatgtgactacttttgacaacgcctcaaacttttctaaccataaaagtaattatactggtgagaaatcctagaaatctgaagagtgagataaagcctttaaatggttgtcacacttcattgtaggtaagataattcatactggagaaaacgcctacatgtgtgaacaatatggcaaaacttaatgctcacactttattgctaggaaagcatttatacttgagataaattatacaaatataaagactgtgaaaaagccatcattatctgctcacattttactcaacacagagagttcctgcttaataaaagcattataagtgcaattactgtcaaaagatctttcagaaaatataagcttttttagtgaagagtatttattttgaagttgaacatcacaaatataaaaagggttgtagtgcctttacttgtatcacagatctttttgtagacattttcttctagaggaaaactctgaagcagttgatcaaactttgttcaacatcagggaatttatattgaaaaattgtgcaaatataataaatttggaaaaacaatttttcaaaaactacagcttagaaatcaacagttatactagaatatattttttccagatgcagtaaaagtaaaatatttaatccataattaagtctatgcaaatatcagagaatttatggtagaaatatataaggtactgacacttcagatatactaaatcagagtgctaagtatagaaaatctgaaactaaagttggtagaaaagttatttgtatagaactttaagaggatcagaaggttttttgcagagttataattacattcaaagtatactttatttcttgaaaaatattacagattttttgaaaattgaataatgtcatcattcaactctgaaattatttcctgttgtttcttcattcctattggattcacatgtgaaagcatggggttaattgttgctacatcaaagagagagattcttttgtttgtttgttcgtttgttttttgagactgagtttcactctttcgcccaggctggagtgcattggcatgatctcagctcactacaacctctgccttctggtttcaagcaactcttctgcctcagcatcccaagtagctgggataacaggtgccagccaccatgcccagctaatttgtgtatttctagtagagatggggtttcaccatattggccaagctggtcttgaactcctgacctcatgtgatccgcccgcctcagcctcccaaagtgctgggattacaggcttgagccaccacgcccagcctgtagcatattttaataggagaatacaatatataatagtagcagggttaagtaaggcatccatcatctgtagcatttctcctttgttttacaaacaatccaattctacactttaaaaaaaaatttttaaatgtacaattaaatttttatttaccacagtgttatttttatcgtcataataaaaattatatacgagtataaatgaaattcatttctaaattcttaataaatattttctcatgcaaaaaaaaaaaaaaa

SEQ ID NO: 610 - DNA, 2786 bp, Human
ctgtcaatcaggcgcacggctggcagtagggtgccaggttcaaagagcccgcggcgtcttcacgcccctgcgctcagctctagactcagtcgctcgctgagagacgccctggaacgtctgtgtagcctcagtcgctgagagacgccctggaacgtctgtggcagcctctgtcacagtgggacccgcactggcagcgggaggcagagggaggaccctggaacatcccggaagccgggaaatggacgcagtggcctttgaggatgtggctgtgaacttcacccaggaggaatgggctttgctgggtccatcacagaagaatttatacagatatgtgatgcaagaaaccatcaggaacctggactgtataagaatgatatgggaagaacagaatactgaagatcagtacaaaaatcctaggagaaatctaagatgtcatatggtagagagattcagtgaaagtaaagacagtagtcagtgtggagaaacatttagcctcattcgagatagtattgtgaacaacagcatttgtcctggagaagatccatgtcaaagcgctgagtgtgaagaagtcataatgggtcatttatcccttaatagccacatcagagttgattctggacacaaaccacatgagtatcaggaatatggagagaagccacatacacataaacaacgtgggaaagccttcagttaccatcactcctttcagtcgcgtggaaggcctcacactggaaagaaacgctatgagtgtaaggaatgtggaaaaaccttcagttctcgtagaaaccttcgaagacacatggtagtgcaaggtggaaatagaccttataaatgtaagttgtgtgggaaagcttttttttggcccagtttattacgtatgcatgaaagaactcacactggagagaaaccgtatgaatgtaagcagtgttctaaagcctttcctttttacagttcctatcgaagacatgagagaatgcacactggggagaaaccgtatgaatgtaagcagtgttctaaagccttgcctgattccagttcctatataagacatgaaagaactcacactggagagaaaccatatacatgtaaacagtgtgggaaagccttcagtgtttccagttcccttcgaagacatgaaaccactcacagtgcagagaaaccctatgagtgtaagcaatgcgggaaaacatttcatcatcttggaagctttcagatacacatgaaaaggcacactggagatcgacctcataaatgtaagatatgtgggaaaggctttgatcgtcccagtttagttcgatatcatgaacgaattcacactggagagaaaccctatgaatgcaagcagtgtgggaaaacgttatctcatagctcaagctttcgaagacacatgataatgcacactggaggtggacctcataaatgcaagatatgtgggaaagcttttgtttatcctagtgtatgtcaaagacacgaaaagtctcacagtggagagaaaccctatgaatgcaagcagtgtgggaaagcgttatctcatagctcaagctttcgaagacatatggtaatgcatacgggagatgggccgaataaatgcaaggtatgtgggaaagcctttgtttatcccagtgtatgtcaaagacatgaaaagactcactggagagaaacaatatgaatgtaaactattataaagccttctatatttccagttccctttgatatcatgaataaacttacactggacagaaaccctataaatgtaaatgtgggaaagcctttcataatttttattcctttcaaaatcatgaaatatctcacactggagagatgctgtatgatataaggaatgtgggaaagtgatcgatttttttttaacaccattgtcaacataaaacaactcacagagcagaaaaactctgtgagtgtaaaatatgtagggaagccttcagtcattttggtaacttaaaagtacatgaggctgggcacagtggctcacgcctgtaatcccagcacttagggtgggcaaattgcttgacctcaggaatttgaggcctgcctgggcaaaatggtgaaaccatgtctctacaaaaaatagaaaaagtagcaggtgtggtggtatgcccctgtagtcccagctacttgggaggctgaggtgggaagatctcttgagcccaaggggtgggggttgcagtgagccaagatgcactgcaccccagcctgggcgacagagccagaccctgtctcaaaaaaaaaaaaaaagtacatgaaaggattcactctggagagaagtcatatgaatgtaagaaatgtagaaaagcattgagttctctcaggtccttgcatagacataaaaggactcactggagagatactctataaatgtgtgaaatgtagggaagtattctttaatgttatttcatttcagatagaaataattctcattggagataaaccctatgaatgtaaacacatagtaaagccttaattttaagcctcagtttctttcaaatacagttatcccctaatatttgcaggagcgtggttctaccaccccctgggcatacataaatcgacacatgccaagtccttttttaaaaatgacatatttggtacaaaattacccggatgtgatggcacatgcctgtaatcccagctactcaggaggctgaggcaggataatcacttgaatccgggaggcggaggttgcggtgagccaagatcgcgccactgcactccagcctgggcagcaagagcaaaacaacctctgtcacacacacaaaaaaaaaaaaaaa

SEQ ID NO: 611 - DNA, 3854 bp, Human
gcgtgagtgagtacagaagggaaatgagtgagggggcatgggatctcagagaaaatcagggccctctgagcaaagtggaaaggacgaccgccgcagctcctcgggccgtagctcgaccccgccttcccttttgcgcagaatcctcgccttggctgcagcagcgcgctgcccccactggccggcgtgccgtgatcgatcgcaggctgcgtcaggagcctcccggcgtataaataggggtggcagaacggcgccgagccgcacacagccatccatcctcccccttccctctctcccctgtcctctctctccgggctcccaccgccgccgcgggccggggagccaccggccgccaccatgagttccttcagctacgagccgtactactcgacctcctacaagcggcgctacgtggagacgccccgggtgcacatctccagcgtgcgcagcggctacagcaccgcacgctcagcttactccagctactcggcgccggtgtcttcctcgctgtccgtgcgccgcagctactcctccagctctggatcgttgatgcccagtctggagaacctcgacctgagccaggtagccgccatcagcaacgacctcaagtccatccgcacgcaggagaaggcgcagctccaggacctcaatgaccgcttcgccagcttcatcgagcgcgtgcacgagctggagcagcagaacaaggtcctggaagccgagctgctggtgctgcgccagaagcactccgagccatcccgcttccgggcgctgtacgagcaggagatccgcgacctgcgcctggcggcggaagatgccaccaacgagaagcaggcgctccagggcgagcgcgaagggctggaggagaccctgcgcaacctgcaggcgcgctatgaagaggaggtgctgagccgcgaggacgccgagggccggctgatggaagcgcgcaaaggcgccgacgaggcggcgctcgctcgcgccgagctcgagaagcgcatcgacagcttgatggacgaaatctcttttctgaagaaagtgcacgaagaggagatcgccgaactgcaggcgcagatccagtacgcgcagatctccgtggagatggacgtgaccaagcccgacctttccgccgcgctcaaggacatccgcgcgcagtacgagaagctggccgccaagaacatgcagaacgctgaggaatggttcaagagccgcttcaccgtgctgaccgagagcgccgccaagaacaccgacgccgtgcgcgccgccaaggacgaggtgtccgagagccgtcgtctgctcaaggccaagaccctggaaatcgaagcatgccggggcatgaatgaagcgctggagaagcagctgcaggagctggaggacaagcagaacgccgacatcagcgctatgcaggacacgatcaacaaattagaaaatgaattgaggaccacaaagagtgaaatggcacgatacctaaaagaataccaagacctcctcaacgtgaagatggctttggatattgagattgcagcttacaggaaactcttggaaggcgaggagacccgactcagtttcaccagcgtgggaagcataaccagtggctactcccagagctcccaggtctttggccgatctgcctacggcggtttacagaccagctcctatctgatgtccacccgctccttcccgtcctactacaccagccatgtccaagaggagcagatcgaagtggaggaaaccattgaggctgccaaggctgaggaagccaaggatgagcccccctctgaaggagaagccgaggaggaggagaaggacaaggaagaggccgaggaagaggaggcagctgaagaggaagaagctgccaaggaagagtctgaagaagcaaaagaagaagaagaaggaggtgaaggtgaagaaggagaggaaaccaaagaagctgaagaggaggagaagaaagttgaaggtgctggggaggaacaagcagctaagaagaaagattgaacccccatttccttaattatttcaggaataattctcccgaaatcaggtcaaccccatcaccaaccaaccaaccagttgagttccagattctatgtgaattaaaaagtcaatatatgtataattctgagatgacttaggttggacattcaatgttgtgctatgaatttcctctttatgcagagtatctgtttgcttgcagagtggctttctggcttgctgccagcctgtgcatggaccacgcttatgagttcaggatctacggcaatgtgaatcattcagatgtttacaataaaaaacaccacatgagtaaatgaattcactaatgttaatgttaaacttcatggaaaaatagtcctttgaaccttcggtggttagcaattaaagaccctgagttatgtgcaataaatagtaaataaagttataccgaatgatgtattttttgctgtggttgttacttaattaaaataccttaaagatggcaccaatataaagtatataccagtggactattgacctccaattttttaaaaagttgaaattttaacaattaccaatacttttttttcttccttcaattggaaattctgagggatacagttatgtcatgattacttgtgaaatctctccccacaaaaattttactgataataaacatgagtaaatgagaaagtctataaataacaatagactttgcctcataacacgtgttgtgttaggttttgggatggctttctagggagcaattctgaaattacttgacagatacactctttatggtaaacaggtcatttcagagtctagagtgctaaccattacactatggaaccatgataaataggtcatttcaaactgatatgtcacaatgcaatatggatagaatatgaatcccatacattcatccctataactgcattttaaaatatagtctaaatatcatgggaggaggttaaaacctgagaacatggtacaataagaaggaataattttttatctatatataatttcaggagaagggattaaaactaccaaaggttatttgccactccactgcaaacatgttgcctgcaatcctgagctcatgatttagtgtgttgttaagcgtaattctgttgcctcaagtaaataccacttaatgctacacatttttaaacctttaaaagctacagacacaagtaatgaaattatgagtcacttaaggggggaggtaatatgcttgtatgttacattgacattgctctgcatgtctctactgggagatatttggatttcaatgatagcttgactggttggacattgcatcaaatacacgccccatgtatcctttctgtcgtaaagttaagaacgctcttgcatttgatgtggaataaatatagatgatattactatctgctattctgcctttgttctgaaacaattgctttgtcagctaatttcattcaatatttgttttttagacgatctctataagttattaatttaacctgaaaccaaagtggtctccatttaaagttacttaatccctttgtaccacctatttctagttaaatatatgttgctatgcaaataggtaaagtgcttccttgccatgatggtaatggattggaactatgaaggctctcagtgtattggcttctgtaaagatgaggcgtctcctcagaaacaaaacttttcacatttctgcttactagacctgggttgatgtacatggtaagtctcaaacagatgcaagctatgtgcaaaaagtaactttagccaaatggaaatagctggatgctttgagaattacttggttgaagtaagaaaactgtaccatcctctatcctgtgtgccataataaaatagtaaaaaacctaaaaaaaaaaaaaaaa

SEQ ID NO: 612 - DNA, 2265 bp, Human
gctctcggccaatgcggagccccgcgcggaggtcacgtgcctctgtttggcgcttttgtgcgcgcccgggtctgttggtgctcagagtgtggtcaggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaagatgtacttctggactcacgggcctggggcccacccagcacagatctctgctgagcaatcttgtctccactctgttcctgccctttgcccagccctgggcctccaatctgcattgattacctggtctgatctctctcaccatcactaggtacttaataaatatttgctgttgatgatagcaatgaccttgagactgatgaacagtctggccaagaggatccttgatgtggaagatagaaaaagcctttggggtcaggcagacttggattctaataccagccagttctgcttgctgtgtctgagcctcagtttactcatctgtgaagaggaggtagcaagaatgaaaatgcctgccttgtggtttgttgtaaggacagacactgccaacgtagagggcccagcagctcacagaccagttgctctgagagcagaccactcttgccttgatggtagggaactatttttgtgcgtggcaagtgggaccttaggaaggaaggcaactgtgaggcttctgagaaggaccctacacaagggagtttcctcccagggcaggtgaatggagagggtggcagaagcctacgggaaggggtcacagggatcagctagagagtgccaccacccttcctggggaatgcagggcaaggtccctggtgggagttttcctgggaagccaaagaagcgcccaacaaagacagaatcaacatttgggtacctttggtacccagaggcagcaatgccaactacaaccacactggaagaagaagaccttctccgcatagattctctgatctcttcctccttcatggcaccagccctggggaaccagcatggtggggaaataatgaagctggaatacaaccacttacagacttcacaacctcctcctgtagataccaaagggattttaggatcacattttatttctcacctgagcaagaaaagctacaggagcatctcaagcagagggcaggagtctccagaggagttcaaggggctctggcaagaaaaatcaaggggctgtgttcaagaactggctcccttggtgattgtattacgaagcccatgtgtgctggatgctgatgaaattgctgccaaatgcctgtgcagccttggcaaggccctttatttctctgggtctccatttctctctctcttttttttttttttttttttttgaggcagagtctcactctgtcgcccaggctggagggcagtggcgtgatctcggctcactgcaagccccaccttctgagttcacgccattctactgcctcagcctcccgagtagctgggactacaggcgcccaccaccacgcccggcttattttttgtatttttagtagagacggggtttcaccgcattagccaagatggtctcgatctcctgacctcgtgattcacccacctcagcctcccaaagtgctgggattacaggcatgagccactgcgcccggcctgggtctccgtttctctagctgtgaaatgactgttctaaaagagccctgccggactttggcagtctgtaagaagacctgagttcttctctcagttccaagcaggaaaattgaacataccctgagcccagagcctgcaacaaactctgggcagcctcaggaagtcaggcagtgaagtcggaaaaatgatctcttctgtatagggagaaaataaaagtttaaaaatttgtaaaaaaaaaaaaaagaaaaaaaaaaaaa

SEQ ID NO: 613 - DNA, 2702 bp, Human
gccaaagtgccacgttgggcccggcggcggcgtgaagactggcggctgcgtgagactccggctccaggcgttcgcaccgtaatgcccggccgttggggccgtcggtaggcgcgaggcgagtcgaggcagccggccggtcggcggccgccggcgggaacggggctgaggcggcgcagcggagtctgggcggcggcgcgtcccgcccgagggcggctctggctgagggcggaggggccggggaagagcccggggcagcggctgaggcgggacggcggcgggggccgctgcccctagaagacccagccgagatgctggcggaaaacctggtagaggagtttgagatgaaggaggacgagccgtggtacgaccaccaggacctccagcaagatcttcaacttgctgctgagcttgggaagacattactggatcggaacacagagttggaggactctgttcagcagatgtatacaaccaatcaggagcagttacaggaaattgagtatctgacgaagcaagtggaacttctacggcagatgaacgaacaacatgcaaaggtttatgaacaattagacgtcacagcaagggaactggaagaaacaaatcaaaagctagttgctgacagcaaggcctcacagcaaaagattctgagcctgactgaaacgattgaatgcctgcaaaccaacattgatcacctccagagccaagtggaggagctgaagtcatctggccaagggagaaggagcccgggaaagtgtgaccaggagaaaccggcacccagctttgcatgtctgaaggagctgtatgacctccgccaacacttcgtgtatgatcatgtgttcgctgagaagatcacttccttgcaaggtcagccaagccctgatgaagaggaaaatgagcacttgaaaaaaacagtgacaatgttgcaggcccagctgagcctggagcggcagaagcgggtgactatggaggaggaatatgggctcgtgttaaaggagaacagtgaactggagcagcagctgggggccacaggtgcctaccgagcacgggcgctggaactagaggccgaggtggcagagatgcgacagatgttgcagtcagagcatccatttgtgaatggagttgagaagctggtgccagactctctgtatgttcctttcaaagagcccagccagagcctgctggaagagatgttcctgactgtgccggaatcacatagaaagcctctcaagcgcagcagcagtgagacgatcctcagcagcttggcagggagtgacatcgtgaagggccacgaggagacctgcatcaggagggccaaggctgtgaaacagaggggcatctcccttctgcacgaagtggacacgcagtacagcgccctgaaggtgaagtatgaagagttgctgaagaagtgccaagaggaacaggactccctgtcacacaaggctgtgcagacctccagggctgcagccaaggacctgactggagtgaacgcccagtctgagcctgttgccagcggctgggaactggcctctgtcaacccagagcccgtgagttcccctacaacacctccagaatacaaagcgttgtttaaggagatctttagttgcatcaagaaaactaagcaggaaatagatgaacagagaacaaaataccgatcactctcctctcattcttaattgaacctctagctctactactaatttgcctattgcctatcgcctctctctcccattcagacaagtgtttgtagactctgaagcctaatgttactcatgacgtttgcctcattgctttgcttatttagcaaatgcatacaacgaggaaaggaggtggctagtggtatcagttctctgatccacttccatttaagctccccaggaaatcccatgacaaactggcctctggctggcgcgctgattagacttcagttcctgaaaaggaccagtggagggaagagctatacttctggagaagtaggcctggagttactacagtatgggggaaaagggtcgagttagaacaaagctaaggcaattcctattgcttccttgcgcaacttctcaaaacgatgaaagtcagaaggctgtcaaactcaaatatctttgcaaacagtttgaatactgtgaattcattacgaagaatgttcgagagaaagcaggggtctaatccaaaagaaatgtcattaaccaatactccaagtccttgagttttgttatatctgaactagttgaactgtgactgacaggtaatcctaatatatccaaatccaactgaataccaaattgagatggcaaatttttgtttgatataagttagcttgttagcatatgccctagagggcctccatccctgtattctaatgtttttactcaaagctctagcctttaggataggtgaatatgtaaatcttttatcactttctcaaattcaaactaaaggggaaagatcaaaccccttcccttcctacctgttttctgagctggctgacttgccagccacaagctgctcttgcagagttcttaccattcctgtaaatgttttgacttgttgcagaaattcctatctactttattaagcagtattgatctgactgtggaaacatcctctcacttgcattcttttaacttaaaactatttaagaactgatgttccgattattgtatatatttttctaaaaaccaaataaagctacctatgaaaatgaa

SEQ ID NO: 614 - DNA, 3475 bp, Human
gaggaggtcggctttgttctcgccccgccctctccccgcctcctccctagatatcgcgagagggcgggtccgcttggcttcggcgtcgcgtcgctcctgcgctggagctctaggccggcgtctctccgcgagccgcgggtcaagtggcagtggctaagggtgcgcgagtagccgccacccgttcggcgttggctctggcgtcggggtcgttgtgtcgtgacaaccgctgcggtagccgtttccgaggcagcagttgcggccgctttagccctgagcgggatctgcggctgcctgcgagtctctgctgtgccgacccttctcttcgcggaccccacgccaagcagcgaccctgagccgacagccggagcgcccggcaatggcggcctcgacggcctcgcaccggcccatcaaggggatcttgaagaacaagacctctacgacttcctctatggtggcgtcggccgaacagccccgcgggaatgtcgacgaggagctgagcaaaaaatcccagaagtgggatgaaatgaacatcttggcgacgtatcatccagcagacaaagactatggtttaatgaaaatagatgaaccaagcactccttaccatagtatgatgggggatgatgaagatgcctgtagtgacaccgaggccactgaagccatggcgccagacatcttagccaggaaattagctgcagctgaaggcttggagccaaagtatcggattcaggaacaagaaagcagtggagaggaggatagtgacctctcacctgaagaacgagaaaaaaagcgacaatttgaaatgaaaaggaagcttcactacaatgaaggactcaatatcaaactagccagacaattaatttcaaaagacctacatgatgatgatgaagatgaagaaatgttagagactgcagatggagaaagcatgaatacggaagaatcaaatcaaggatctactccaagtgaccaacagcaaaacaaattacgaagttcatagacgagatttgttcaacactgcaattgtttgttagatgtaaaccctgtgactatagtacgttgcttcttgttcttcacaattcatgacttaagtaccaaaatgcataccagttattatatattgccaagaattaaatgataaacttagagactgattagactgaaaatgcctaatcgatatatatattcttgtgcctagtactttaccacaaatacagtgtaatatcatcagtccaaaactgcattacttttgtaaaaacactggttaatttgtataagatattatagagctttttatgctttagaagttaaacaatatctttgggggggaactaatttattttcatcacttgaaatgtggtagctcttacaaagtttattgatttgatttttttaaaaatcaaaagccaattgaacaacaggatatatagactgataaatatttaggctgaatagtattttaacacttgtcttcaacttgatttgtctgtttaattgaaaagaattataagagttactgttgcattttctgacctactatttttaaaattcctgttgagtttctttgtgtttacaaggaaaggactgaactttttctcatcaaaactagcttttttccccacaaataaattatcaggttaaactttcaccaatgtctgctctgttttttgtttttggggggttttttctcatgcaaagaaaaccctcaaaaaacaaacaaaaaaaaccctcagttagttgttttcttaagtctaattaatccaaactaataatagccatttaattagcaatctgtaaatcagagaggtatagaaattcagcagctaaactgtatttcccacctatagcactgctgctactcaaactattttcttcacgtattagaagaattcataggcattgatggtcaaaataagaatttcaacatagcagcaaatgacagaagagtgagagaaagagctcctaatgtggtgacagtcttaatgatcctttaaaaggtagaagattgtgtgcgtatgtgtggaaaggagtaggaaagaaaagcaggaggttaagacaggtatttaaagggaatggcgagatagctacattagaatatttatttttttaaaaaactgctctgaagtctgcccagtgtaccaaaaacattaaaaaacaaaaacaaacttattattgtattttattacagtacgtgtagtgtatactaactgaaagggaaaaatgtaaacaaaaccaaagtcatggggaaaatggcatcttgctttaatcttcaactgaaagttaccttaacaatccatttacaccattatgtcaaattttagtcatctctgcagaattttagacaaatgaaaacagacaaggtaacaccaaatagttaagcacagaaagtgatactgattaaaaagttgaaagtaaaatctaccttggctagaactgaacattcagatctgtctctccagaggaaaatctaacttgaatcataatggttcatattttgactagttcataccctatcaattacctacttatgacttgaacataccttttctcagctgcatgtgacagcctaaaaccccactgagcatgctgcttggcatgccttactcctctgaaatcatcatctactttctaaaaaccagaaaatgagtttgtgatttaaatttcaaaaaatagtttgtagaaaacacaaaaagaatcaactgtttaaagtcttatccttttcttcactctatgacagctacttctacaaaaaaaaaaaaagagtatgtgggtactttctaagaactcagaaacaagaaaaccaaaatcagagggtgcatgaatatatgtgcacgcacatgtacagacttaatctctacatcccccaagacagatttaaacaggtaatcccaacattttaaattcagaaaccagagacaaacagttttgtttctaaatcagtggtattcctagctgaaatgtttagaatactgcactcacagttcagcagtactttgattatatatctcattcaaaaaatcaaaataatggccacattcttctaacagcaaggaattctcccactttttatttattttcaaatactgctgtttccataaacctgcaagtggaagataagctgttcaataaaagccttctttcatatatgtatctatatataaaatatacagacgttattttagaagtctgttcatataacagattattttggtactaacaaaagttgtacacaattcatcaattgtatggctagaaatgaaaccataactaaaccaagacacacagggctttcctgcacttggttgaaggaaaaaattccacctaattcttactgcgttagaagaataaagcacgtttgtcatagtacacattatcgtagtcccttaaagcagggactatttaacaatgtccaggcttacttctgtctgtacattcaggaataatcatatcactggttacatacaatgacaaaaaaaaaaaa

SEQ ID NO: 615 - DNA, 2400 bp, Human
acttccggaatctctcggcgtgtgagcttggttgtcctaccaaagccagcgtttcggctcgcgtgcgccggcctagtttgctcgcgtcctcacgcgctttgggtttcccggtctcatggccggcctgaccttatttgtgggccgcctcccgccctcggcccgcagtgagcagctggaggaactgttcagtcaggtggggccggtgaagcagtgcttcgtggtgactgaaaaaggccggacagtggctgtggattgggccgtggcaaaggataaatataaagatacacagtctgtttctgctataggtgaggaaaagagccatgaatctaaacatcaggaatcagttaaaaagaagggcagagaggaagaggatatggaagaggaagaaaacgatgatgatgacgatgatgatgatgaagaagatggggtttttgatgatgaagatgaagaggaagagaatatagaatcaaaggtgaccaagcctgtgcaaattcagaagagagcagtcaagagaccagcccctgcaaaaagcagtgatcattctgaggaggacagtgacctagaggaaagcgatagtattgatgatggagaggaactggctcagagtgataccagcactgaggagcaagaggataaagctgtgcaagtctcaaacaaaaagaagaggaaattaccctctgatgtgaatgaagggaaaactgtttttatcagaaatctgtcctttgactcagaagaagaagaacttggggagcttctccaacagtttggagaactcaaatatgtccgcattgtcttgcatccagacacagagcattctaaaggttgtgcatttgcccagttcatgactcaagaagcagctcagaaatgccttctagctgcttctccagagaatgaggctggtgggcttaaactggatggccggcagctcaaggttgacttggcggtgacccgtgatgaggctgcaaagcttcagacgacgaaggtgaagaagccgactggcacccggaatctctatctggcccgagaaggcttgattcgtgctgggacgaaggctgcagagggtgtgagtgctgctgatatggccaaaagagaacggtttgagctgctgaagcatcagaaactcaaggaccagaatatctttgtctcccgaaccaggctctgcctgcacaatctcccaaaggctgtagatgacaaacagctcagaaagctgctgctgagtgctactagtggagagaaaggggtgcgcatcaaggagtgtagagtgatgcgagacctcaaaggagttcatgggaacatgaagggtcagtccctgggctacgcctttgcggagttccaagagcacgagcatgccctgaaagccctccgcctcatcaacaacaatccagaaatctttgggcctctgaagagaccaatagtggagttctctttagaagatcgaagaaaacttaaaatgaaggaattaaggatccagcgcagcttgcaaaaaatgagatccaagcctgcaactggtgagcctcagaaggggcaaccagagcctgcaaaagaccagcaacagaaggcagctcaacaccacacagaggaacaaagcaaggtgcccccagagcagaagagaaaggcgggctctacctcatggaccgggttccagaccaaggctgaagtggagcaggtggagctgcctgatggaaagaagagaagaaaggtcctggcgctcccctcacaccgaggccccaaaatcaggttgcgggacaaaggcaaagtgaagcccgtccatcccaaaaagccaaagccacagataaaccagtggaagcaggagaagcagcaattatcgtccgagcaggtatctaggaaaaaagctaagggaaataagacggaaacccgcttcaaccagctggtcgaacaatataagcagaaattattgggaccttctaaaggagcacctcttgcaaagaggagcaaatggtttgatagttgatgatggcagcaggctgggtaagaagctgggttgtgtactttctggtgacactcctgggctcctccccatcccccgtgtctctcactgagggaaagaaaatccccaagggcactgccactgtgctcggaggtgccctggactgtgtacatctgaactttggtccatcctttgatgtgtggttcgttagccacaaagagaaatatctgaaagtcaacatgatgcttcttgcatattatccagattattgtatgaagttgtgtctataattattaccaatttttattctttatttctcaaatggaaacacctgaaaaagcattctggagtgctgaatttttaagatgtatattttgttaagcatattctctaaatgagatattgtgtggctttttagtaacaacgtcatttctaataaaaaaaaaaaaaaa

SEQ ID NO: 616 - DNA, 2825 bp, Human
gtacggcttccggtggcgggacgcggggccgcgcacgcgggaaaagcttccccggtgtccccccatccccctccccgcgccccccccgcgtccccccagcgcgcccacctctcgcgccggggccctcgcgaggccgcagcctgaggagattcccaacctgctgagcatccgcacacccactcaggagttggggcccagctcccagtttacttggtttcccttgtgcagcctggggctctgcccaggccaccacaggcaggggtcgacatggcagagacactggagttcaacgacgtctatcaggaggtgaaaggttccatgaatgatggtcgactgaggttgagccgtcagggcatcatcttcaagaatagcaagacaggcaaagtggacaacatccaggctggggagttaacagaaggtatctggcgccgtgttgctctgggccatggacttaaactgcttacaaagaatggccatgtctacaagtatgatggcttccgagaatcggagtttgagaaactctctgatttcttcaaaactcactatcgccttgagctaatggagaaggacctttgtgtgaagggctggaactgggggacagtgaaatttggtgggcagctgctttcctttgacattggtgaccagccagtctttgagatacccctcagcaatgtgtcccagtgcaccacaggcaagaatgaggtgacactggaattccaccaaaacgatgacgcagaggtgtctctcatggaggtgcgcttctacgtcccacccacccaggaggatggtgtggaccctgttgaggcctttgcccagaatgtgttgtcaaaggcggatgtaatccaggccacgggagatgccatctgcatcttccgggagctgcagtgtctgactcctcgtggtcgttatgacattcggatctaccccacctttctgcacctgcatggcaagacctttgactacaagatcccctacaccacagtactgcgtctgtttttgttaccccacaaggaccagcgccagatgttctttgtgatcagcctggatcccccaatcaagcaaggccaaactcgctaccacttcctgatcctcctcttctccaaggacgaggacatttcgttgactctgaacatgaacgaggaagaagtggagaagcgctttgagggtcggctcaccaagaacatgtcaggatccctctatgagatggtcagccgggtcatgaaagcactggtaaaccgcaagatcacagtgccaggcaacttccaagggcactcaggggcccagtgcattacctgttcctacaaggcaagctcaggactgctctacccgctggagcggggcttcatctacgtccacaagccacctgtgcacatccgcttcgatgagatctcctttgtcaactttgctcgtggtaccactactactcgttcctttgactttgaaattgagaccaagcagggcactcagtataccttcagcagcattgagagggaggagtacgggaaactgtttgattttgtcaacgcgaaaaagctcaacatcaaaaaccgaggattgaaagagggcatgaacccaagctacgatgaatatgctgactctgatgaggaccagcatgatgcctacttggagaggatgaaggaggaaggcaagatccgggaggagaatgccaatgacagcagcgatgactcaggagaagaaaccgatgagtcattcaacccaggtgaagaggaggaagatgtggcagaggagtttgacagcaacgcctctgccagctcctccagtaatgagggtgacagtgaccgggatgagaagaagcggaaacagctcaaaaaggccaagatggccaaggaccgcaagagccgcaagaagcctgtggaggtgaagaagggcaaagaccccaatgcccccaagaggcccatgtctgcatacatgctgtggctcaatgccagccgagagaagatcaagtcagaccatcctggcatcagcatcacggatctttccaagaaggcaggcgagatctggaagggaatgtccaaagagaagaaagaggagtgggatcgcaaggctgaggatgccaggagggactatgaaaaagccatgaaagaatatgaagggggccgaggcgagtcttctaagagggacaagtcaaagaagaagaagaaagtaaaggtaaagatggaaaagaaatccacgccctctaggggctcatcatccaagtcgtcctcaaggcagctaagcgagagcttcaagagcaaagagtttgtgtctagtgatgagagctcttcgggagagaacaagagcaaaaagaagaggaggaggagcgaggactctgaagaagaagaactagccagtactccccccagctcagaggactcagcgtcaggatccgatgagtagaaacggaggaaggttctctttgcgcttgccttctcacaccccccgactccccacccatattttggtaccagtttctcctcatgaaatgcagtccctggattctgtgccatctgaacatgctctcctgttggtgtgtatgtcactagggcagtggggagacgtcttaactctgctgcttcccaaggatggctgtttataatttggggagagatagggtgggaggcagggcaatgcaggatccaaatcctcatcttactttcccgaccttaaggatgtagctgctgcttgtcctgttcaagttgctggagcaggggtcatgtgaggccaggcctgtagctcctacctggggcctatttctactttcattttgtatttctggtctgtgaaaatgatttaataaagggaactgactttggaaaccaaaaaaa

SEQ ID NO: 617 - DNA, 1233 bp, Human
aagcggttggcggcgctcggaagcggccgcggatcggggaattctgctggcgctgcagctgcagaatggtcggcggtggcgggaagcgcaggcccggcggagaggggccgcagtgtgaaaaaacaactgatgtgaagaaaagtaaattctgtgaagctgatgtctccagtgaccttcgaaaagaagtagaaaatcattataagctttctttacctgaagatttctatcacttctggaagttctgtgaagaacttgatcctgaaaagccatctgattcactttctgcaagccttggacttcaattagttggtccttatgatatccttgctggaaaacataaaacgaagaaaaaatcaacaggcctgaattttaaccttcactggaggttttactatgatcctcctgagttccagaccattattattggagataataaaactcagtaccacatggggtatttcagggattctcctgatgaatttcctgtatatgttggtataaatgaagcaaagaaaaattgtataattgttccaaatggagataatgtatttgctgcagtcaaattatttttgacgaaaaaacttagagaaataacggataaaaagaaaatcaatctcttgaaaaacatagatgaaaaactcacagaagcagccagagaattggggtactcgcttgaacagagaaccgtgaagatgaaacagagagataagaaagttgtgacaaagacctttcatggtgcaggcttggttgttccagtagataaaaatgatgttgggtaccgagagctccctgaaacagatgctgacctcaagagaatttgcaagacaatagttgaggctgcaagtgatgaggagagactaaaagcttttgctcccattcaggaaatgatgacttttgtgcagtttgctaatgatgaatgtgattatggcatggggcttgaattgggaatggatctcttttgctatggctcacattattttcataaagttgctggccagcttttacctcttgcatataatctgttgaagaggaatctgtttgcagaaattattgaggagcatctggcaaacagaagtcaagagaacatagaccaacttgctgcatgagtaaggtggctttgattggtgtacagtatttcaaaggactagtattaaacttgtgatttttgttttgtttttaaggaatacaaaaaataaacatttactaaaaacgtttaaaaaaaaaaaaaaaaaa

SEQ ID NO: 618 - DNA, 2958 bp, Human
atccgccctgcccgcagcctctcctccccttcctccccgccgccacggccccgtaggtgctcggggacccaccttccacctagcacgggttcgttcccctctcccggcctggcccgggctccccggtggccgccgccccctcgccgcccccgccttctcccggggagggggtcaggtgggcgggcactattgttgtaggagccggcgccagattcctcagccgcgctcggggtgggaccggctgggtttgggggggtggggtggggggagcggtgatctgagctccgagcagctggtcttcgcggctcgctccctccttcgcgctctctcgctccctgccgccgcccgcagggctgcggggctcggtggcatctcccgggcgcggcccgcagtccttgcccctgcctccgggccgctcccgcccccggcgccgctcgctcccccgacccggactcccccatgtatgacgactcctacgtgcccgggtttgaggactcggaggcgggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctagccaagcagaagcaaaagcaggcggaacatgttcccccatatgacgtggtgccctccatgcggcctgtggtgctggtgggaccctctctgaaaggttatgaggtcacagacatgatgcagaaggctctcttcgacttcctcaaacacagatttgatggcaggatctccatcacccgagtcacagccgacctctccctggcaaagcgatctgtgctcaacaatccgggcaagaggaccatcattgagcgctcctctgcccgctccagcattgcggaagtgcagagtgagatcgagcgcatatttgagctggccaaatccctgcagctagtagtgttggacgctgacaccatcaaccacccagcacagctggccaagacctcgctggcccccatcatcgtctttgtcaaagtgtcctcaccaaaggtactccagcgtctcattcgctcccgggggaagtcacagatgaagcacctgaccgtacagatgatggcatatgataagctggttcagtgcccaccggagtcatttgatgtgattctggatgagaaccagctggaggatgcctgtgagcacctggctgagtacctggaggtttactggcgggccacgcaccacccagcccctggccccggacttctgggtcctcccagtgccatccccggacttcagaaccagcagctgctgggggagcgtggcgaggagcactccccccttgagcgggacagcttgatgccctctgatgaggccagcgagagctcccgccaagcctggacaggatcttcacagcgtagctcccgccacctggaggaggactatgcagatgcctaccaggacctgtaccagcctcaccgccaacacacctcggggctgcctagtgctaacgggcatgacccccaagaccggcttctagcccaggactcagagcacaaccacagtgaccggaactggcagcgcaaccggccttggcccaaggatagctactgacagcctcctgctgccctaccctggcaggcacaggcgcagctggctggggggcccactccaggcagggtggcgttagactggcatcaggctggcactaggctcagcccccaaaaccccctgcccagccccagcttcagggctgcctgtggtcccaaggttctgggagaaacaggggaccccctcacctcctgggcagtgacccctactaggctcccattccaggtactagctgtgtgttctgcacccctggcaccttcctctcctcccacacaggaagctgccccactgggcagtgccctcaggccaggatccccttagcagggtccttcccaccagactcagggaagggatgccccattaaagtgacaaaagggtggggtgtgggcaccatggcatgaggaagaaacaaggtccctgagcaggcacaagtcctgacagtcaagggactgctttggcatccagggcctccagtcacctcactgccatacattagaaatgagacaatcaaagcccccccagggtggcacacccatctgtttgctggggtgtggcagccacatccaagactggagcagcaggctggccacgctcgggccagagagagctcacagctgaagctcttggagggaagggctctcctcaccctgccaggaagcttcttaacatgtgacaggaccagggaccaggagcatggtgaagccaagtggcagatgggagccaacctggatgggggtttggggaaggagggcatgtgtagcagagaacttaggggggcctccttgcctttctcattcttttgccctgcatcctgtcatttctgttcttgtccctcatacatctttggagaaccgggctccagactttgttccctgactcatagctgccgcttgttaggttagggttagatggggagagacagggcacagaggacctgtctccccggctactcttgccttatggctctagtgtgtgacctacagagcatgctccacaagcccctgcctcacctcactgtcatcactaataaacatcatgcacagtccc

SEQ ID NO: 619 - DNA, 3038 bp, Human
ttggccctgggggcggggcgaggcgcagaggtgcgtcctgagggcggggcggtgacgcaagagcgactcctgggggcggggcgaggccttggagatgcgtccggaggcggtggggagcgaagactgacccggggccgtgacgcgggggcaggccctggggcgggggcgggtcctggggactggggcgggcggccgaggcccggaagcggactgaggcggcctggagtcttagttggctactcgccatggacgaagcggatcggcggctcctgcggcggtgccggctgcggctggtggaagagctgcaggtggaccagctctgggacgccctgctgagccgcgagctgttcaggccccatatgatcgaggacatccagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcggtgctcttgagagtttgaggggaaatgcagatttggcttacatcctgagcatggagccctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaagaaaatggtgctggctttgctggagctggcgcagcaggaccacggtgctctggactgctgcgtggtggtcattctctctcacggctgtcaggccagccacctgcagttcccaggggctgtctacggcacagatggatgccctgtgtcggtcgagaagattgtgaacatcttcaatgggaccagctgccccagcctgggagggaagcccaagctctttttcatccaggcctgtggtggggagcagaaagaccatgggtttgaggtggcctccacttcccctgaagacgagtcccctggcagtaaccccgagccagatgccaccccgttccaggaaggtttgaggaccttcgaccagctggacgccatatctagtttgcccacacccagtgacatctttgtgtcctactctactttcccaggttttgtttcctggagggaccccaagagtggctcctggtacgttgagaccctggacgacatctttgagcagtgggctcactctgaagacctgcagtccctcctgcttagggtcgctaatgctgtttcggtgaaagggatttataaacagatgcctggttgctttaatttcctccggaaaaaacttttctttaaaacatcataaggccagggcccctcaccctgccttatcttgcaccccaaagctttcctgccccaggcctgaaagaggctgaggcctggactttcctgcaactcaaggactttgcagccggcacagggtctgctctttctctgccagtgacagacaggctcttagcagcttccagattgacgacaagtgctgaacagtggaggaagagggacagatgaatgccgtggattgcacgtggcctcttgagcagtggctggtccagggctagtgacttgtgtcccatgatccctgtgttgtctctagagcagggattaacctctgcactactgacatgtggggccaggtcaccctttgctgtgaggctgtcctgtacattgtgggatgttcagcactgtcccttgcctcaatgccagtaacgcgtcttcctgagtggtgccaaacaaaaaggttctcaggtgttgccaaatatgtcctggggtataaaactttcctcgcctgacaaccactggtctgtagggatttttggctacacacaaaccagtatcgctcatagatcagcaaaccggggcctactagagtctgaacagctgtaatctatgaattctaagtgaaattttaaaaattgttaatttttcctatattgcattaattttaaaaaataaatctgaggcaaatatggactctcttttgcctatttcttccctcattttgctccaactctttcttcttccttacaaaagagacttttgcttttttcgaaacatttccccatgtttttctggggtctcgctatgttgcccaggctggtctcaaactcctgggctcaagtgaccctcccaagtagctcttactacaggcgtgcaccattgcacccagccccatttattcatgtcttatttcacttgatccttatcccatcccaggaaggcaacaagggtgagaaccctgtgctcagggaggttaggtctcttgtccaagggaaaacgattatccagagaagagacctggccagaacctgggtcccctgagtcctagccatgcttcccatgtgccttacttgctgaagcacccccggactgcagtgtgaacgtgctgtgcaatagtgacacgctgggcttccccacaaggctccaccctgaggtcttttaagctgtccttatgccagcctatttcttgttttttgggcctttttttttggagatagggtctcactctgtcgcccaggctggagtgcaatgacgcaatcttggcttattgcagtctcgacctcctgggctcaagagatccttccacctcagccacctgagtagcttggactacaggtgtgcaccacctctcccagttaatttttgtatttttagtagagacagagttatgccatgttactcaggctggtcttgaactcctggactcaagcgatcagcctgccttagcctcccaaagtgcaggggttacaggcttgagccattgcgcctgacctatttctggttcttagggccctggatgttaggatggatttctgaattaataataataataaaaccctcatcaaga

SEQ ID NO: 620 - DNA, 6457 bp, Human
gtgaatcaaaggagagtcccagaaaacctgtgactgttgaagaaaattcatctgtgaatttttatattcaaggagtcagtatttatattcatcttttaaactgggaagatttatattttactttaaaacttcttgataataatttacaatgaatggacacagtgatgaagaaagtgttagaaacagtagtggagaatcaagccagtcggatgatgattctgggtcagcttcaggctctggatctggttcgagttctggaagcagtagtgatggaagcagtagccagtcaggtagcagtgactctgactccggatctgaatcaggcagtcagtcagagtctgagtcagacacttcccgagaaaacaaagttcaagcaaaaccaccgaaagttgatggagctgagttttggaaatctagtcctagtattctggccgttcagagatctgcaatcctcaagaagcagcaacagcagcagcagcaacaacaacatcaagcctcatctaatagcggatcagaagaggattcctctagcagtgaagattccgatgactcatcaagtgaggtcaaaaggaaaaagcataaagatgaagattggcaaatgtctgggtcaggatctccatctcagtctggttcagattcagaatctgaagaagagagagagaaaagcagttgtgatgaaacagaatctgattatgagccaaaaaacaaagtcaaaagcagaaaacctcaaaatagatctaagtcaaaaaatggaaagaagattcttggacaaaaaaagagacagattgattcatctgaggaggatgatgatgaagaagattatgataatgataaaagaagttctcgtcgccaagcaactgttaatgttagctataaggaggatgaagaaatgaaaacagattctgatgacctactggaagtctgtggagaggatgttcctcaacctgaggaagaggaatttgaaaccatagaaagatttatggattgtcggattgggagaaaaggagctactggtgctactacaaccatctatgcagttgaagcagatggtgacccaaatgcaggctttgaaaaaaacaaagaaccaggagagattcagtatttaattaaatggaaaggatggtcccatatccacaacacttgggagacagaagaaaccctcaagcagcagaatgttagaggaatgaaaaaattggataattataagaaaaaagatcaggaaacaaaaagatggttgaaaaatgcctctccagaagatgtggaatattataattgccagcaagaacttacagatgatctacataaacagtatcaaatagtggaacgtataattgctcattccaatcaaaagtcagcagctggttatcctgattattactgcaaatggcagggccttccatactcagagtgcagctgggaagatggagctctcatttccaaaaagtttcaagcatgcattgatgagtattttagcaggaaccaatcaaaaaccactccttttaaagattgcaaagtattaaaacaaaggccaaggtttgtagccctgaagaagcagccatcctatattggaggacatgagggcttagaattaagagattatcaactgaatggtttaaattggcttgctcattcttggtgcaaaggaaatagttgcatactcgctgatgaaatgggccttggaaaaacaatacagacgatctcatttctgaattatttgtttcatgaacatcaattatatggaccttttttattggtagtaccgctctccactcttacttcctggcaaagggaaattcagacttgggcttctcaaatgaatgctgtggtttatttaggtgacattaacagcagaaacatgataagaactcatgaatggacgcatcatcagaccaaacggttaaaatttaatatattgttaacaacttatgaaattttattaaaagataaggcattccttggaggtctaaattgggcatttataggtgttgatgaagcacaccgattaaagaatgatgactcccttctgtataaaactttaatagattttaaatccaatcatcgtctccttatcactggaactcctctacagaattccctcaaagagctctggtctttgctacatttcattatgccagaaaagttttcttcctgggaagattttgaagaagaacatggcaaagggagagaatatggttatgcaagccttcacaaggagcttgagccatttctgttacgccgagttaagaaagatgtggaaaaatctcttcctgccaaggttgagcagattttaagaatggaaatgagtgctttacagaaacaatattacaaatggattttaactaggaattacaaagccctcagcaaaggttccaagggcagtacctcaggctttttgaacattatgatggagctaaagaaatgttgtaaccattgctacctcattaaaccaccagataataatgaattctataataaacaggaggccttacaacacttaattcgtagtagcggaaaattgattcttcttgacaagctattaattcgcctaagagaacgaggcaatcgagttcttattttttcacaaatggtgcggatgttagatatacttgcagaatatttgaaatatcgtcaattcccctttcaaagattagatggatcaataaaaggagaactgaggaaacaagctctagatcattttaatgctgagggatcagaggatttttgctttttgctgtccacaagagctggaggtctagggattaatttagcctctgctgacactgttgttatatttgattccgattggaatccacagaatgatcttcaggcacaggctagagcccatcgaattgggcaaaagaaacaggtgaatatttatcgtctagttacaaagggatcagttgaagaagatattcttgaaagggcgaaaaagaagatggttttagatcatcttgtaattcaaagaatggacacaactgggaagacagtactacatacaggttctgccccatcaagttctactcctttcaataaagaagagttatcagccattttaaagtttggtgctgaagaactttttaaggaacctgaaggagaagaacaagagccccaggaaatggatatagatgaaatcttgaagagagctgaaactcatgaaaatgaaccaggtcctttaactgtaggagatgaattgctttcccagttcaaggttgccaacttctcaaatatggatgaggatgacattgagttggaacctgaaagaaattcaaagaattgggaggaaattattccagaagatcaaagaagacgattagaagaagaagaaagacaaaaggaacttgaagaaatttatatgctcccaagaatgagaaattgtgcaaaacagattagtttcaatggaagtgaagggaggcgcagtagaagtaggagatactctggatctgatagtgattccatctcagaagggaaaaggccaaagaaacgtggaagaccacggactattcctcgggagaatattaaaggatttagtgatgcagaaattaggcggtttatcaagagctataagaaatttggtggtcctctggaaagattagatgcaattgctcgagatgctgagttagttgataagtcagaaacagaccttagacgactgggagaattggtacataatggttgcattaaagcattaaaggatagttcttcaggaacagaacgaacaggtggtagactcggaaaagtgaagggtccaacattccgaatatcaggagtacaggtgaatgccaaactagtcatctcccatgaagaagaattaatacctttgcacaaatccattccttctgatccagaagaaagaaagcagtatactatcccatgccacacaaaggcagctcattttgatatagactggggcaaagaagatgattccaatttgttaattggcatctatgaatatggatatggaagctgggaaatgattaaaatggatcctgacctcagtctaacacacaagattcttccagatgatcccgataaaaaaccacaagcaaaacagttgcagacccgtgcagactacctcatcaaattacttagtagagatcttgcaaaaaaagaagctctttctggtgcgggaagttcaaagaggagaaaagcaagagctaagaagaataaagcaatgaagtctataaaagtgaaagaggaaataaagagtgattcttctcctctgccttcagagaagtctgatgaagatgatgataaattgagtgaatccaagtctgatggtagggaaagatccaagaaatcttcagtgtcagatgctccagttcatatcacggcaagtggtgaaccagttcccatttctgaagaatctgaagagctggatcagaagacattcagcatttgtaaagaaagaatgaggcctgttaaagcagctttgaaacaacttgataggcctgagaaaggcctttcagaaagagaacaactagagcatactagacaatgtttaataaaaattggagaccatatcacagaatgtctaaaagagtatacaaatcctgaacaaattaagcaatggagaaaaaacctgtggatttttgtatctaagtttactgaatttgatgcaagaaaattacataaattatataagcatgctattaaaaaacggcaggagtctcagcaaaacagtgatcaaaacagcaacttgaatcctcacgtgattagaaatccagatgtggaaagattaaaagagaatacaaatcacgatgatagcagcagggacagttattcctctgatagacacttaactcagtaccatgatcatcataaagaccgacatcagggagattcttacaaaaaaagtgattccaggaaaagaccctattcttcttttagtaatggtaaagaccatcgtgattgggatcactacaagcaagacagcagatattacagtgacagagagaaacacagaaaactggatgatcacaggagtagagatcacaggtcaaatttggaaggaagtttaaaagatagatctcattctgatcatcgttctcactcagatcatcggttacattcagaccaccggtcaagttctgaatatacgcaccataaatcttccagggattataggtatcactcagactggcaaatggaccacagagcttccagcagtggccctaggtcaccactagatcagagatctccttatggctccagatctccatttgaacattcagttgaacacaaaagtacaccggagcatacctggagtagtcggaaaacataacaaaaactgatacttcgtctttctggacttttcttttagccatatatcataaaccaacacagtaattgccttacatgacttgaaagatataaacagatcttctatcagtagcagtattgttacttctttccaggatgcaaggtctattatcccaacagaagagaaaatatttttatatttaaggattatgctgcactgtactacaaaattgtagtacttttttttgttttcttttttaaagaaatggaaaatgtttactattacagggacctcaacactgccctcccatacaggctggataaaactgtttttaagtcagtgattttagactgacctccatttaaattatgtttatatatgaactttactctgacctgtgatcatgtttcaggaaggaatgaaagagagttctttcttaataaagaaaaacactcaaggactttgttcatttccaaagctacttgtttacattgtacactgcgaccaccttgccgcttttcatcacaagcttgaatatttaaattctgtacttatatctgtaaaatagccaggaatttcctgtttgtgatctattatgcctttttacaaaaaaaatggctgtaaattattgtaaatattaaaggaactttccttacttccttccctttctcaggctttttttgactgttcctttccctaccaactcaggccttcttattaaaaaaaaaaaaatcagtgtaataacactttttaatgatttgtcttgatggaatcattgtttagaatgtaaaaatggggaaaggggccacttaattccattagtcctctttttatactgaatattttattagatacatgttattcccttttttttccttttttagtcaatattgtgtttgtagttttaaaaaatggcgagatatgtaaaatctaaactgcatgctctggaaacacttttttcagatgcatctggtttaaaagggtaggtgtataaacacttttcagaatccaaaacggccaaaagttattgtaaatccgtttgttttcccgttttatgtgggcaataatgtcaaatgtgctatgcagccaggttaacattttagataaacttgattgacttttaatataaactgttacaatgcacactgattgtatataaaaacgttatatatgacaaattaaatttaagaaaaagga

SEQ ID NO: 621 - DNA, 2276 bp, Human
agcgcaggctcctccgactccgccagcgcagggggcgcggctgccggggacccagcagcgggcgcgcggataatctggagctttcaaaatgtttgccaaagcaaccaggaattttcttagagaagttgatgctgatggtgacctgattgcagtatcaaatctgaatgactctgataagttacagcttctaagtctggtgacaaaaaagaagagattctggtgctggcagagacccaagtaccagtttttatccctcacccttggcgatgtactcatagaagaccaatttccgagtccagtggtcgtggagtcggactttgtgaaatacgagggcaagtttgcaaaccacgtgagtggaaccctggagactgcactggggaaggtcaagctgaacctggggggcagcagccgcgtagagagccagtcttcatttggaaccctgaggaagcaggaggtggatttgcagcagctcatcagagactctgccgagagaacaataaatctgagaaaccctgtgctccagcaggtgctggaaggaaggaatgaggtcctgtgcgttttgacacagaagatcacgacgatgcagaagtgtgtgatctctgagcacatgcaggtcgaggagaagtgtggtggcatcgtgggcatccagaccaagacggtgcaggtgtcagcgacggaggatgggaatgtcaccaaggactccaacgtggtgctggagatcccagctgccaccaccattgcctacggtgtcattgagttatacgtgaaactggacggccagttcgagttctgccttctccgagggaagcaaggtggcttcgagaacaagaagagaattgactctgtctacctggaccccctggtctttcgagagtttgcattcatagacatgccagatgctgcgcatgggatatcttcccaggatggaccattaagtgttttaaagcaagcgaccctgctcctggagaggaatttccatccatttgcggagctgcctgagccacaacagacagctttgagtgacatcttccaggcggtcctatttgatgatgaactactcatggtcctggaaccagtgtgcgatgacctggtcagcggcctctcgcccacagtggcggtgctgggggagctgaagccccggcagcagcaggaccttgtggccttcctgcagctggtggggtgcagcttacagggtgggtgtccgggccccgaggatgcaggcagcaagcagctgtttatgacagcctacttcttggtcagtgccctcgcagaaatgccagatagcgcagcagctctgctgggcacttgctgcaaactccagatcattcccacactgtgccacttgcttcgtgctctgtctgatgatggagtatctgatcttgaagacccaaccttgactcccctgaaagatacagaaaggtttgggattgtgcagcgcttgtttgcctcagctgacattagtctggagagactgaagtcatctgtgaaagctgtcattctgaaggactctaaagtcttcccactgcttctttgtataaccctgaatggactctgtgctttaggcagagaacattcatgatgtcatatgtgaactagaagtacgtgttactggccaaggctatttttcagaactgttaaaggtcatatgcacgttaaaagttgaccaatgaaatgaatttacagaacagtttaagaagtggtgacattttgcatgatgaatgacctgacttttagccaccaggtactctttaaacagttttccttatcagaggccctcctgtgctggtgacccagcatctgagttaggttccagcatgtaaagagctgggagggcggagaattcttagcatacattcagacgttttttctgcacaataataagtccatctgtcacttgcattccactttttgttacatagaaagagtctgaccctttaatccaaaaggtctttttacattgtgaatgctgtgggaaggcaatttctctgcacacaagaggctacgttttggaagtgatgtatgttatttgatgactgaaaatgaactgtaaatgctcctagagtatattcctctgctgaacaaaattaaacttcaaaaaaatctaacagtaacacacccctgcttgggaccctagctatatgcattttatgtgaccttgccatgcttcagtgaacatactaattctatgtctagcacatgttgatttcctatgtattctgggtattctattaaaggaaactttgaactatgaaaaaaaaaaaaaaaaaaaaaaaaaa

SEQ ID NO: 622 - DNA, 2308 bp, Human
aaaggaagtgcctccggcgcaagtggcattgagggacttgtagtcctgcgatttcgggtgtagagggagcaggggcctgcggggacctggtgtgggtggagtggggacaagcggtggagaagggtacgccagggtcgctgagagactctgttctccctggagggactggttgccatgagagcagccgtctgaggggacgcagcctgcactacgcgccccaagaggctgtgcgtggcgagcaggtcacgtgacgggagcgcgggctttggaaggcggctgaacgtcaggccacccgccgctaagctgagaagggagagcgagcttaggaccgcctgcccggggcaaccccgaaccaagctttagccgccgaggccgcgtgtcccaaaggccagtcatccctcctctgtgttgccatgggaattcaaggcctggccaaactaattgctgatgtggcccccagtgccatccgggagaatgacatcaagagctactttggccgtaaggtggccattgatgcctctatgagcatttatcagttcctgattgctgttcgccagggtggggatgtgctgcagaatgaggagggtgagaccaccagccacctgatgggcatgttctaccgcaccattcgcatgatggagaacggcatcaagcccgtgtatgtctttgatggcaagccgccacagctcaagtcaggcgagctggccaaacgcagtgagcggcgggctgaggcagagaagcagctgcagcaggctcaggctgctggggccgagcaggaggtggaaaaattcactaagcggctggtgaaggtcactaagcagcacaatgatgagtgcaaacatctgctgagcctcatgggcatcccttatcttgatgcacccagtgaggcagaggccagctgtgctgccctggtgaaggctggcaaagtctatgctgcggctaccgaggacatggactgcctcaccttcggcagccctgtgctaatgcgacacctgactgccagtgaagccaaaaagctgccaatccaggaattccacctgagccggattctgcaggagctgggcctgaaccaggaacagtttgtggatctgtgcatcctgctaggcagtgactactgtgagagtatccggggtattgggcccaagcgggctgtggacctcatccagaagcacaagagcatcgaggagatcgtgcggcgacttgaccccaacaagtaccctgtgccagaaaattggctccacaaggaggctcaccagctcttcttggaacctgaggtgctggacccagagtctgtggagctgaagtggagcgagccaaatgaagaagagctgatcaagttcatgtgtggtgaaaagcagttctctgaggagcgaatccgcagtggggtcaagaggctgagtaagagccgccaaggcagcacccagggccgcctggatgatttcttcaaggtgaccggctcactctcttcagctaagcgcaaggagccagaacccaagggatccactaagaagaaggcaaagactggggcagcagggaagtttaaaaggggaaaataaatgtgtttccccattatacctccttcaccccagaatatttgccgtcttgtacccttaagagctacagctagagaaaccttcacggggtggagagaggattctaaggcttttctagcgtgacccttttcagtagtgctagtcccttttttacttgatcttaatggcaagaaggccacagaggtacttttccttttttagctcaggaaaatatgtcaggctcaaaccacttctcaggcagtttaatggacactaagtccattgttacatgaaagtgatagatagcaacaagttttggagaagagagagggagataaaagggggagacaaaagatgtacagaaatgatttcctggctggccaactggtggccagtgggaggtgatggtggacctagactgtgcttttctgtcttgttcagccttgacccaccttgagagagagccaccaggaaggcgcatcttagcagatgggaggaactgctgagagaagatgggcagaaagctggagcccctggagttggctgtgtctgtgtttgtgactgattactggctgtgtcttgggtgggcagaaactcgaacttgctatgtaatttgtgtctagttattcagaggagtaagatggtgatgttcacctggcaatcagctgagttgagactttggaataagacactggttttcatgcgctgtttttgttttaaagttatgaagaaaaaagtcaataaaattctaaaagtaaccaaaaaaaaaaaaaaaa

SEQ ID NO: 623 - DNA, 1560 bp, Human
cccgatcgggaagtggcgggcggagtcccgggtccagtcgccgcctcagctaccgccgctgccgccgccgccgccgccaccgccagtggtgagaccccgacctggcgggtcagcgctgggcgtgcgtgcgggcaggcgggggcgctgacgagaagcaggaagagggtgcagtgccggcgtgggcggccggccgaggcggaggcgcaggaagggggcggcgagtcgtgcgaggctgcccttctcactcagcattatggatccaagcctgttgagagaaagggagctgttcaaaaaacgagctctttctactcctgtagtagaaaaacgttcagcatcttctgagtcatcatcatcatcgtcaaagaagaagaaaacaaaggtagaacatggaggatcgtcaggctctaaacaaaattctgatcatagcaatggatcatttaacttgaaagctttgtcaggaagctctggatataagtttggtgttcttgctaagattgtgaattacatgaagacacggcatcagcgaggagatacgcatcctctaaccttagatgaaattttggatgaaacacaacatttagatattggactcaagcagaaacaatggctaatgactgaggctttagtcaacaatcccaaaattgaagtaatagatgggaagtatgctttcaagcccaagtacaacgtgagagataagaaggccctacttaggctcttagatcagcatgaccagcgaggattaggaggaattcttttagaagacatagaagaagcactgcccaattcccagaaagctgtcaaggctttgggggaccagatactatttgtaaatcgtcccgataagaagaaaatacttttcttcaatgataagagctgtcagttttctgtggatgaagaatttcagaaactgtggaggagtgtcactgtagattccatggacgaggagaaaattgaagaatatctgaagcgacagggtatttcttccatgcaggaatctggaccaaagaaagtggcccctattcagagaaggaaaaagcctgcttcacagaaaaagcgacgctttaagactcataacgaacacttggctggagtgctgaaggattactctgacattacttccagcaaatagggaacagttttgccctggaacagagttacagatacacaatcaagagtgttcttgctgatgctcggggtctgaagactgtcttcctatctgcttcttgcggctgaggagaggagcagttcagtttacaaaacaagtgcaaattaccaaactcaaagcttatttgagtagaatgggctcatgggcaatgtgatgttccctgttaaccttctgttactccctgggagaaaggcgctgagcgtggcatgcaggtgtctttgctgtgtttttctccacttctaaatggttcctggttcctttcttcctcgtttgttactttagagcaagtttgcccatagtcttgaatgcaatatttgtttattccaaaagaacatatttataataaaatcactgtagaaggatttttaagaaaaaaaaaaaaaaaaaaaaaaaaa

SEQ ID NO: 624 - DNA, 3402 bp, Human
atgcctgccctcctgggaatgaagcacagcaggtctcagcctcatcttacccagccccccactcaagatggaggtgcctggtttgaacacctctgacaaatggaagtctgtgttgtccagaggcaatgcagtgggggcttaagaagataactctggacttagaccgcttggcttcaaatcaaagagtgcatgaaccaaccagctggcctagtgatgatgttaggcaagtgacttctcagtttcttcatctgcaaactgggaaatttcctatctcagggttaaaagagaggtaatcttaggtgcttacctagcacatgcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatgggaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgatgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacgctgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctggtaatttaagattccagagagtggctcctcccggtgcccaagaatagatgctgactgtactcctcccaggcgccccttccccctccaatcccaccaaccctcagagccacccctaaagagatactttgatattttcaacgcagccctgctttgggctgccctggtgctgccacacttcaggctcttctcctttcacaaccttctgtggctcacagaacccttggagccaatggagactgtctcaagagggcactggtggcccgacagcctggcacagggcagtgggacagggcatggccaggtggccactccagacccctggcttttcactgctggctgccttagaacctttcttacattagcagtttgctttgtatgcactttgtttttttctttgggtcttgttttttttttccacttagaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtggccgtgtttgccatctgttttagcagagcctagacaagggccacagacccagccagaagcggaaacttaaaaagtccgaatctctgctccctgcagggcacaggtgatggtgtctgctggaaaggtcagagcttccaaagtaaacagcaagagaacctcagggagagtaagctctagtccctctgtcctgtagaaagagccctgaagaatcagcaattttgttgctttattgtggcatctgttcgaggtttgcttcctctttaagtctgtttcttcattagcaatcatatcagttttaatgctactactaacaatgaacagtaacaataatatccccctcaattaatagagtgctttctatgtgcaaggcacttttcacgtgtcacctattttaacctttccaaccacataaataaaaaaggccattattagttgaaaaaaaaaaaaaaaaaaaaaaaaa

SEQ ID NO: 625 - DNA, 787 bp, Human
ggactgtggaggggcgcacgcccggaagcggcgagggtagccatgacggcctccgtgctgcgaagtatctcgctagccctgcgcccgactagcgggcttctgggaacttggcagacgcagcttagagagactcaccagcgagcgtcattgttgtctttctgggaactcattcccatgagatcagaacctcttcgaaaaaagaagaaggtagatcctaaaaaagaccaagaagcaaaggagcgcttgaaaaggaagatccgaaaactggaaaaggctactcaagagctaattcctattgaagattttattacccctctaaagttcttggataaagcaagagagcggcctcaggtggagctcacctttgaggagactgagaggagagctctgcttctgaagaagtggtccttgtacaagcagcaagagcgtaagatggagagggacaccatcagggctatgctagaagcccagcaggaagctctggaggaactgcaactggaatccccgaagctccatgctgaggccatcaagcgggatcctaacctgttcccctttgagaaggaagggccacattacacaccaccgatccctaactaccaaccccctgaaggcaggtacaatgacatcaccaaggtgtacacacaagtggagtttaagagatagacttgcaggctgctatccttaacatgctgcccctgagagtaggaatgaccagggttcaagtctgctttccacagaatcaggcatgctgttaataaatactggtttaatcaaaaaaaaaaaaaaa

SEQ ID NO: 626 - DNA, 1865 bp, Human
agagcgctggggagagagtggagcgccgttcgccggtatgtgcgcatgcgttgaggtctcttgacgccgattggggggtcacgagtcacgggcggcgtgcggcggctggtgggggcgtgtccggcggagcgggcgcggcgttacgaggccgctggttggccagcgctagtcacgtggttcctggccgcaagcgacgcgcgccggtgcgacgtcaacgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtgccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgtcccccagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttgcatgagtcaaaaa

SEQ ID NO: 627 - DNA, 2752 bp, Human
accaattgggacatcacatccctggctctgggttagaaagctgacagtccttgatcctgtggccactgccccatcattcctgctcctgaggactcagtctcatggctgtggcagaggtgtccaggacctgcctgctcacggttcgtgtcctgcaggcccatcgcctaccctctaaggacctagtgaccccctctgactgctacgtgactctctggctgcccacggcctgcagccacaggctccagacacgcacggtcaagaacagcagtagccctgtctggaaccagagctttcacttcaggatccacaggcagctcaagaatgtcatggaactgaaagtctttgaccaggacctggtgaccggagatgaccctgtgttgtcagtactgtttgatgcggggactctgcgggctggggagttccggcgcgagagcttctcactgagccctcagggtgaggggcgcctggaagttgaatttcgcctgcagagtctggctgaccgtggcgagtggctcgtcagcaatggcgttctggtggcccgggagctctcctgcttgcacgttcaactggaggagacaggagaccagaagtcctcagagcacagagttcagcttgtggttcctgggtcctgtgagggtccgcaggaggcctctgtgggcactggcaccttccgcttccactgcccagcctgctgggagcaggagctgagtattcgcctgcaggatgcccccgaggagcaactaaaggcgccactgagtgccctgccctctggtcaagtggtgaggcttgtcttccccacgtcccaggagcccctgatgagagtggagctgaaaaaagaagcaggactgagggagctggccgtgcgactgggcttcgggccctgtgcagaggagcaggccttcctgagcaggaggaagcaggtggtggccgcggccttgaggcaggccctgcagctggacggagacctgcaggaggatgagatcccagtggtagctattatggccactggtggtgggatccgggcaatgacttccctgtatgggcagctggctggcctgaaggagctgggcctcttggattgcgtctcctacatcaccggggcctcgggctccacctgggccttggccaacctttatgaggacccagagtggtctcagaaggacctggcagggcccactgagttgctgaagacccaggtgaccaagaacaagctgggtgtgctggcccccagccagctgcagcggtaccggcaggagctggccgagcgtgcccgcttgggctacccaagctgcttcaccaacctgtgggccctcatcaacgaggcgctgctgcatgatgagccccatgatcacaagctctcagatcaacgggaggccctgagtcatggccagaaccctctgcccatctactgtgccctcaacaccaaagggcagagcctgaccacttttgaatttggggagtggtgcgagttctctccctacgaggtcggcttccccaagtacggggccttcatcccctctgagctctttggctccgagttctttatggggcagctgatgaagaggcttcctgagtcccgcatctgcttcttagaaggtatctggagcaacctgtatgcagccaacctccaggacagcttatactgggcctcagagcccagccagttctgggaccgctgggtcaggaaccaggccaacctggacaaggagcaggtcccccttctgaagatagaagaaccaccctcaacagccggcaggatagctgagtttttcaccgatcttctgacgtggcgtccactggcccaggccacacataatttcctgcgtggcctccatttccacaaagactactttcagcatcctcacttctccacatggaaagctaccactctggatgggctccccaaccagctgacaccctcggagccccacctgtgcctgctggatgttggctacctcatcaataccagctgcctgcccctcctgcagcccactcgggacgtggacctcatcctgtcattggactacaacctccacggagccttccagcagttgcagctcctgggccggttctgccaggagcaggggatcccgttcccacccatctcgcccagccccgaagagcagctccagcctcgggagtgccacaccttctccgaccccacctgccccggagcccctgcggtgctgcactttcctctggtcagcgactccttccgggagtactcggcccctggggtccggcggacacccgaggaggcggcagctggggaggtgaacctgtcttcatcggactctccctaccactacacgaaggtgacctacagccaggaggacgtggacaagctgctgcacctgacacattacaatgtctgcaacaaccaggagcagctgctggaggctctgcgccaggcagtgcagcggaggcggcagcgcaggccccactgatggccggggcccctgccacccctaactctcattcattccctggctgctgagttgcaggtgggaactgtcatcacgcagtgcttcagagcctcgggctcaggtggcacggtcccagggtccaggctgagggctgggagctcccttgcgcctcagcagtttgcagtggggtaaggaggccaagcccatttgtgtaatcacccaaaaccccccggcctgtgcctgttttcccttctgcgctaccttgagtagttggagcacttgatacatcacagactcatacaaatgtgaaaaaaaaaaaaaaaaaa

SEQ ID NO: 628 - DNA, 2643 bp, Human
gcttcagttaccagccggctacgtcgcgcctgcgctttgacccccagtttgcgccccaactccggtcgtgcggccgcccggggagggctctgcagttgcgcagcttgctccccggcccttttcccctccgctccccgccgcctcctgacgccgggcgtgacgtcaccacgcccggcggccgccattacagagagccgagctctggagcctcagcgagcggaggaggaggcgcagcggccgacggccgagtactgcggtgagagccagcgggccagcgccagcctcaacagccgccagaagtacacgaggaaccggcggcggcgtgtgcgtgtaggcccgtgtgcgggcggcggcgcgggagcagcgcggagcggcagccggctggggcgggtggcatcatggacgagaaggtgttcaccaaggagctggaccagtggatcgagcagctgaacgagtgcaagcagctgtccgagtcccaggtcaagagcctctgcgagaaggctaaagaaatcctgacaaaagaatccaacgtgcaagaggttcgatgtccagttactgtctgtggagatgtgcatgggcaatttcatgatctcatggaactgtttagaattggtggcaaatcaccagatacaaattacttgtttatgggagattatgttgacagaggatattattcagttgaaacagttacactgcttgtagctcttaaggttcgttaccgtgaacgcatcaccattcttcgagggaatcatgagagcagacagatcacacaagtttatggtttctatgatgaatgtttaagaaaatatggaaatgcaaatgtttggaaatattttacagatctttttgactatcttcctctcactgccttggtggatgggcagatcttctgtctacatggtggtctctcgccatctatagatacactggatcatatcagagcacttgatcgcctacaagaagttccccatgagggtccaatgtgtgacttgctgtggtcagatccagatgaccgtggtggttggggtatatctcctcgaggagctggttacacctttgggcaagatatttctgagacatttaatcatgccaatggcctcacgttggtgtctagagctcaccagctagtgatggagggatataactggtgccatgaccggaatgtagtaacgattttcagtgctccaaactattgttatcgttgtggtaaccaagctgcaatcatggaacttgacgatactctaaaatactctttcttgcagtttgacccagcacctcgtagaggcgagccacatgttactcgtcgtaccccagactacttcctgtaatgaaattttaaacttgtacagtattgccatgaaccatatatcgacctaatggaaatgggaagagcaacagtaactccaaagtgtcagaaaatagttaacattcaaaaaacttgttttcacatggaccaaaagatgtgccatataaaaatacaaagcctcttgtcatcaacagccgtgaccactttagaatgaaccagttcattgcatgctgaagcgacattgttggtcaagaaaccagtttctggcatagcgctatttgtagttacttttgctttctctgagagactgcagataataagatgtaaacattaacacctcgtgaatacaatttaacttccatttagctatagctttactcagcatgactgtagataaggatagcagcaaacaatcattggagcttaatgaacatttttaaaaataattaccaaggcctcccttctacttgtgagttttgaaattgttctttttattttcagggataccgtttaatttaattatatgatttgtctgcactcagtttattccctactcaaatctcagccccatgttgttctttgttattgtcagaacctggtgagttgttttgaacagaactgttttttccccttcctgtaagacgatgtgactgcacaagagcactgcagtgtttttcataataaacttgtgaactaagaactgagaaggtcaaattttaattgtatcaatgggcaagactggtgctgtttattaaaaaagttaaatcaattgagtaaattttagaatttgtagacttgtaggtaaaataaaaatcaagggcactacataacctctctggtaactccttgacattcttcagattaacttcaggatttatttgtatttcacatattacaatttgtcacattgttggtgtgcactttgtgggttcttcctgcatattaacttgtttgtaagaaaggaaatctgtgctgcttcagtaagacttaattgtaaaaccatataacttgagatttaagtctttgggttttgttttaataaaacagcatgttttcaggtagagcttaaactaaatgatgtgtttacttagtgcagtttctggttatgaatattatattgctatgtgtatattatatggactctttaaaatgattgacagattggcaaattcttaaatctttgtacattgttgagtcatatgttcttagagttaaatttgtctcagataagaaagtgttaaagcattagcctgtgtcaagttctttgagtgatactagtgaaaccaaatagaaaactattgttggatcatgatttagtcttatgtacattcacccga

SEQ ID NO: 629 - DNA, 2869 bp, Human
agaattctttggcaggggcgaccttagaatcctggggaggagcgagaatggaatcccggggaggaacaggggtggaatccggggggcggggtcagaacgccaggagggggcggggccggagccagggtcggcttgactcgggggagcagcgggtggatcctgtgacgtcagcgggttcgaaccgccggagctgagcgagaggccgggggtgccgagccgggcggggagagctgggccgggagagcagaacagggaggctagagcgcagcgggaaccggcccggagccggagccggagccccacaggcacctactaaaccgcccagccgatcggcccccacagagtggcccgcgggcctccggccgggcccagtcccctcccgggccctccatggcccgggccgctgccctcctgccgtcgagatcgccgccgacgccgctgctgtggccgctgctgctgctgctgctcctggaaaccggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagagacccccaacacagcaggcgcaggggccacaggcggcatcatcgggggcatcatcgccgccatcattgctactgctgtggctgccacgggcatccttatctgccggcagcagcggaaggagcagacgctgcagggggcagaggaggacgaagacctggagggacctccctcctacaagccaccgaccccaaaagcgaagctggaggcacaggagatgccctcccagctcttcactctgggggcctcggagcacagcccactcaagaccccctactttgatgctggcgcctcatgcactgagcaggaaatgcctcgataccatgagctgcccaccttggaagaacggtcaggacccttgcaccctggagccacaagcctggggtcccccatcccggtgcctccagggccacctgctgtggaagacgtttccctggatctagaggatgaggagggggaggaggaggaagagtatctggacaagatcaaccccatctatgatgctctgtcctatagcagcccctctgattcctaccagggcaaaggctttgtcatgtcccgggccatgtatgtgtgagctgccatgcgcctggcgtctcacatctcacctgttgatcccttagctttcttgccaaggatctagtgccccctgacctctggccaggccactgtcagttaacacatatgcattccatttgtgatgtctaccttggtggctccactatgacccctaacccatgagcccagagaaattcaccgtgataatggaatcctggcaaccttatctcatgaggcaggaggtggggaaggtgcttctgcacaacctctgatcccaaggactcctctcccagactgtgaccttagaccatacctctcaccccccaatgcctcgactcccccaaaatcacaaagaagaccctagacctataatttgtcttcaggtagtaaattcccaataggtctgctggagtgggcgctgagggctccctgctgctcagacctgagccctccaggcagcagggtcccacttaccccctccccaccctgttccccaaaggtgggaaagaggggattccccagcccaaggcagggttttcccagcaccctcctgtaagcagaagtctcagggtccagacccttccctgagcccccacccccaccccaattcctgcctaccaagcaagcagccccagcctagggtcagacagggtgagcctcatacagactgtgccttgatggccccagccttgggagaagaatttactgttaacctggaagactactgaatcattttacccttgcccagtggaataggacctaaacatcccccttccggggaaagtgggtcatctgaattgggggtagcaattgatactgttttgtaaactacatttcctacaaaatatgaatttatactttgaccaggaaaaaaaaaaaaa

SEQ ID NO: 630 - DNA, 2444 bp, Human
acggatataagattgcgtgggttctgcctaaagctgaattcccagcgctttggcttctctgagttggggttgtgtataggggtcttcgaacagttccggaaccagccagcagcctttaattcttgggcggaccacggccggttctgtgttcttggctaagatgagcagccaccataccacctttccttttgaccctgagcggcgagtccggagtacgctgaagaaggtctttgggtttgactcttttaagacgcctttacaggagagtgcgaccatggctgtagtaaaaggtaacaaggacgtctttgtgtgcatgcccacaggggcaggaaaatccctatgctatcagctccctgctctgttggccaaaggcatcaccattgtagtctctcctctcattgctttgattcaggaccaagtggaccacttgctaaccctaaaggtacgagtaagttccctgaactcgaagctctctgcacaggaaaggaaggagctgcttgctgacctggagcgagaaaagccccagaccaagattctgtacatcaccccagagatggcagcttcatcctccttccagcccaccctgaactccctggtgtcccgccacctgctgtcttacttggtggtggatgaagctcattgtgtttcccaatgggggcatgactttcgtcctgactacttgcgtctgggtgccctgcgctcccgcctgggacatgccccttgtgtggctctgaccgccacagccaccccacaggtccaagaggacgtgtttgctgccctgcacctgaagaaaccagttgccatcttcaagactccctgcttccgggccaacctcttctatgatgtgcaattcaaggaactgatttctgatccctatgggaacctgaaggacttctgccttaaggctcttggacaggaggctgataaagggttatctggctgcggcattgtgtactgcaggactagagaggcttgtgaacagctggccatagagctcagctgcaggggtgtgaacgccaaggcttaccatgcagggctgaaggcctctgaaagaacgctggtgcagaacgactggatggaggagaaggtccctgtaattgttgcaaccattagttttgggatgggagtggataaagccaatgtcaggtttgtcgcccattggaatattgccaagtctatggctgggtactaccaggagtctggccgggctggcagggatgggaagccttcctggtgccgtctctattactccaggaatgaccgggaccaagtcagcttcctgatcaggaaggaagtagcaaaactccaggaaaagagaggaaacaaagcatctgataaagccactatcatggcctttgatgccctggtgaccttctgtgaagaactggggcgatggggcaggggccacggaaagagtctgagggctgcttggtgtagtcaggttgtgtccaggcatgcggagctgtgagtgcctgcaggagagacacccaggaggagtttttacattttggtctaaaaagctcttggattcatctcatctcatggaatgatcctgtcggatgacgctgacgtgattgcttcagacttagaggtgaataaattgaggtccagagaggtcacagtcacgaagctcatggtagactgaggccactaaacacccgtctcctgattttcagtggcgtcctcatttgcatacacctgggccatcttggtttttgcaagaaaaaagcgaggaaatcagagaaactctttgggctgtgtgtttttatttccacctcctcctgttgaccagtgagtcggtggcttctggactgaagctattttcttctccaaactgctgtctctaatttggcctctgtggcaagaccacgcccagcaaaagtggtcggctgcagtgccaggaccacccttgcctgcagcctttgcgaccagagcccttttcaagcacaattaatatgggagttgctaaatttggccttcttaggcttcttgagcagagctcttatttctggtgaggaatgaaagggccaagtgttcctgttcattgtgagtcctgtttgctgaaaaaagctctggggctgtctgaggctctggaatgctctctggagggttaactctgcctgtccccagggtctgctccgcctgccaggcaagggaacaggtcctcccaagggcctctgccttcatttctcctgtcaccttccggggagctgggacttcttagtgcatcagtggcctggttgccaggggctggggtccaggcatctgtggactcaaggagtccaggtgacggtgttgcgctgcctcttgagcagcctcgtgcctgtctcctttgctacatgtgatgattctgaaatccaggcagcaggctggaataaacgctgctggtatgtcaaaaaaaaaaaaaaaaaaaaaaaaaaaaaaaaaaaaaaaaaaaaaaaaaa

SEQ ID NO: 631 - DNA, 2610 bp, Human
caggggcggaggcggcggccagggaggaagcggaggaggcggaggcggccgcggcgttcgcccgcccgctcgctcgctcggtttccccgcccccgccgggcttaacgccgctgaaggtatccgggtgcgcgctgtcgcaacctgccctcatcctggcccgcgactgtaagaccggacccacatccagaccaatcttcctgtccgggctgctgcgacgcgggctccgcaggttgcaggcgggcggccggggcgcctgaaggttaccgagtgcatgagcgcctagcgcttcccgcgctgccccgcccgctggcccgccgacccgcccgccggctcgcccgccagcccctcggcgcccggcggcggcggcggcggtggcggcgacggtcgcaggaggtgccgtctgcctcccaggtgcgcgcttcgctcccggagccgcggaactcggcggccgccatggcgtccaacatggaccgggagatgatcctggcggattttcaggcatgtactggcattgaaaacattgacgaagctattacattgcttgaacaaaataattgggacttagtggcagctatcaatggtgtaataccacaggaaaatggcattctacaaagtgaatatggaggtgagaccataccaggacctgcatttaatccagcaagtcatccagcttcagctcctacttcctcttcttcttcagcgtttcgacctgtaatgccatccaggcagattgtagaaaggcaacctcggatgctggacttcagggttgaatacagagacagaaatgttgatgtggtacttgaagacacctgtactgttggagagattaaacagattctagaaaatgaacttcagatacctgtgtccaaaatgctgttaaaaggctggaagacgggagatgtggaagacagtacggtcctaaaatctctacacttgccaaaaaacaacagtctttatgtccttacaccagatttgccaccaccttcatcatctagtcatgctggtgccctgcaggagtcattaaatcaaaacttcatgctgatcatcacccaccgagaagtccagcgggagtacaacctgaacttctcaggaagcagtactattcaagaggtaaagagaaatgtgtatgaccttacaagtatccccgttcgccaccaattatgggagggctggccaacttctgctacagacgactcaatgtgtcttgctgaatcagggctctcttatccctgccatcgacttacagtgggaagaagatcttcacctgcacagacccgggaacagtcggaagaacaaatcaccgatgttcatatggttagtgatagcgatggagatgactttgaagatgctacagaatttggggtggatgatggagaagtatttggcatggcgtcatctgccttgagaaaatctccaatgatgccagaaaacgcagaaaatgaaggagatgccttattacaatttacagcagagttttcttcaagatatggtgattgccatcctgtattttttattggctcattagaagctgcttttcaagaggccttctatgtgaaagcccgagatagaaagcttcttgctatctacctccaccatgatgaaagtgtgttaaccaacgtgttctgctcacaaatgctttgtgctgaatccattgtttcttatctgagtcaaaattttataacctgggcttgggatctgacaaaggactccaacagagcaagatttctcactatgtgcaatagacactttggcagtgttgtggcacaaaccattcggactcaaaaaacggatcagtttccgcttttcctgattattatgggaaagcgatcatctaatgaagtgttgaatgtgatacaagggaacacaacagtagatgagttaatgatgagactcatggctgcaatggagatcttcacagcccaacaacaggaagatataaaggacgaggatgaacgtgaagccagagaaaatgtgaagagagagcaagatgaggcctatcgcctttcacttgaggctgacagagcaaagagggaagctcacgagagagagatggcagaacagtttcgtttggagcagattcgcaaagaacaagaagaggaacgtgaggccatccggctgtccttagagcaagccctgcctcctgagccaaaggaagaaaatgctgagcctgtgagcaaactgcggatccggacccccagtggcgagttcttggagcggcgtttcctggccagcaacaagctccagattgtctttgattttgtagcttccaaaggatttccatgggatgagtacaagttactgagcacctttcctaggagagacgtaactcaactggacccaaataaatcattattggaggtaaagttgttccctcaagaaacccttttccttgaagcaaaagagtaaacacggcccagcggtggaaccagccattccttgacaagccagcagcctgcgtcaggagaagggctcctcgccaacccacccacacgctcgtctcactcaattcaatgtcacacttctgcctcttgcaaaattgctggaaaaagtaataataaatatagctacttaagatttcccatcaaaaaaaaaaaaaaaaaaaaaaaaaaa

SEQ ID NO: 632 - DNA, 4136 bp, Human
ccctccgaaatctcgcgagggtaggtgcgcgtcggtattttgcgggcaactagctcttccagctgctgtaaattgctgctgcgggagaaactggagccgctgtagccggcgcgcccttcttcccttactgcgaggagccaccgcctctttcgcgctccttatacacctatcactgggagcggtggcagcaacattccctggaccaaccgccgcctcttcaggcggccgctttgccggtcattcccgaagcccggcaactgagggcggccccctttccttaacagtctcctcgctacagatcgtctgctccctcagcctcgcccgagacccacttccccagtctcgcccgggtggaggtcgacgaggaggagacaagagtcacccttcctccaggcggcgccggccccctcacccgcgggtgtgtcctataaatggcgtcggaaagcgacaccgaggaattctatgatgcccctgaagatgtgcacctagggggcggctaccccgtggggtctccaggaaaagttgggctttcaacattcaaggaaacagagaacactgcatacaaagttggaaatgagtcccctgtacaagaattgaaacaagatgtgtctaaaaagattattgaaagtattattgaggagagtcagaaagtactacagcttgaagatgactctttggattccaaaggaaaagaactctctgatcaagctactgccagtcctattgtggctagaacagatctgagcaatatacccggactgttagccatagatcaagtactaccggaagaatcccaaaaggcagagagtcagaatacatttgaagagactgaattagaattaaaaaaatgctttccttctgatgaaacctgtgagaaaccagtagatgaaaccacgaagttaactcaaacaagttcaactgagcagcttaatgtgcttgaaactgaaacagaagtattgaacaaggaagcagtggaagtcaaaggaggtggtgatgttttagagcctgtgtcctcagactccttatctactaaagattttgccgctgtggaagaagtggcccctgccaaacccccaagacaccttactccagagcctgatatagtggctagtacaaagaagcctgttccagcacgcccacctcctccaactaatttcccacctcctagacccccacctccttctcgacctgctccaccaccaagaaaaaggaaaagcgaattggaatttgagactctgaaaactcctgatatagatgttcccaaagagaatattacgtctgattctctcctaaccgcaagcatggcttcagaaagtacggttaaggattctcagccttctcttgatttggcaagtgctaccagtggagataaaatagttaccgcccaggaaaatggaaaagcacctgatgggcagactgtagcaggtgaagtgatgggccctcagagacctagatccaactctgggagagagcttactgatgaggaaattttagccagtgtaatgattaagaacctggatactggagaagaaatacctttgagtcttgcagaagagaaactaccaacaggcattaatcctctcactctacacatcatgagaaggacaaaagaatatgtaagtaatgacgcggcacagtcagatgatgaagagaagttacagtctcagccaacagatactgatggtggaaggttaaaacagaaaacgactcaactaaagaagtttcttggaaaatcagtaaagagagcaaagcaccttgctgaggaatatggtgaacgtgctataaataaagttaaaagtgttagagatgaagtgtttcatactgatcaagatgatccttcatcaagtgatgatgaaggaatgccatacacaagaccagttaaattcaaagcagcacacggtttcaaaggaccttatgattttgatcagatcaaagtggtgcaagatcttagtggtgaacatatgggagctgtttggaccatgaaattttctcactgtggccgattacttgcctcagctggacaagacaatgtagtgagaatatgggctttaaaaaatgcttttgactatttcaacaatatgcgaatgaaatacaatactgaaggacgtgtgtccccatcaccctctcaggaaagtctaagttcatcaaaatcggatacagatacaggggtatgcagtggaactgatgaagaccctgatgataaaaacgcaccctttcggcaacggccattttgcaaatataaaggacatactgctgatctccttgatctttcatggtctaaaaactactttcttctttcttcttcaatggataaaacagtcagattatggcacatttctcgaagagaatgcctttgctgttttcaacatatagattttgtcactgccatagcttttcatccaagagatgacaggtattttctaagtgggtctttggatggaaagctccgcctttggaacatacctgacaaaaaagtggctttgtggaatgaagtagatggtcagacaaaattgatcacagctgcaaatttctgtcagaatggcaaatatgcagtgattgggacatatgatggcagatgtattttctatgatacagagcatttgaaataccatacacaaatacatgtccgatctactagagggcgcaacaaggttggaagaaaaattactggcattgagcctttacctggagaaaataagatattggtaacctcaaatgactccagaatcagactatatgatttgagagatttgtcactatccatgaagtataagggttacgtcaatagcagcagccagatcaaagcaagtttcagtggttcagaagataagtatgtttatatctggagtacctaccatgacctaagcaagtttacttcagtcaggagagatcgtaatgacttctgggaaggtattaaagcccacaatgcagttgttacatcagccatctttgcaccaaacccaagtttgatgttatctttggatgtgcaatctgaaaaatcagaagggaacgagaaaagtgaagatgctgaagttttggatgccacaccttctggtattatgaagacagataacacagaagttcttctctctgctgacttcactggagcaatcaaagtgtttgttaataaaagaaaaaatgtatcttaatttgaaatggcatttaaaataaacatatcagtaagtttctatatgtatcaaaactgaaaaaatagtgttccaggctaacatacttttttaatttttattgaaagttgttcaaatataatatattttttgagaggcagtgttaatgatctaggaaaccctgggctgatagagtagaaaggaatatggctagaataacattgccaaacattaggctttatgttttgttatgtttgtgttttcgttgtataattatgaacatgcacaagtttctgcatgaaaagatattaatatattaatcacatgtatgtgccttttggttacatgcattaaatctaacagagttaaattatttcagtggctcttttggcctcttactaggggggatagtcttgtttctagcttaaacaattttttttttgcacaaaatttcatttttaataaaagtggtatcttttgactgagttattgttttgaaaatggtatataggtttccagtaggtcaacaaccatatgtaaatggtttttataaatttctcaatttggggacaagatttttttgtggtctaaattgtgggcttaagattcttttctttatatgtgtacatataatttttttttctttgccacactggagcacaatgtttctatgtaaagaattattttcattctttatccatgagcaccaggctttgctcacttaaaaaaaaattaagccacattaaggagtgagtcttcttttttacaataatgtaaaaattaaactgtttacatttttttaaagcattgtagtttttaaaaattaagctgttttgttttgtgttgttgaatttgaaagcctttgtaaatatcaatataatgtaccaatgaaataacatctggggcaatgaaaccctgatcatgttgttgatggttagcatatgtttctgaaaattaaatatgtattattaaaagttggtctccaacacttgtttaaaaaaaaaaaaaaaa

SEQ ID NO: 633 - DNA, 3734 bp, Homo sapiens
caaatgcgaacttaggctgttacacaactgctggggtctgttctcgccgcccgcccggcagtcaggcagcgtcgccgccgtggtagcagcctcagccgtttctggagtctcgggcccacagtcaccgccgcttacctgcgcctcctcgagcctccggagtccccgtccgcccgcacaggccggttcgccgtctgcgtctcccccacgccgcctcgcctgccgccgcgctcgtccctccgggccgacatgagtggggaccacctccacaacgattcccagatcgaagcggatttccgattgaatgattctcataaacacaaagataaacacaaagatcgagaacaccggcacaaagaacacaagaaggagaaggaccgggaaaagtccaagcatagcaacagtgaacataaagattctgaaaagaaacacaaagagaaggagaagaccaaacacaaagatggaagctcagaaaagcataaagacaaacataaagacagagacaaggaaaaacgaaaagaggaaaaggttcgagcctctggggatgcaaaaataaagaaggagaaggaaaatggcttctctagtccaccacaaattaaagatgaacctgaagatgatggctattttgttcctcctaaagaggatataaagccattaaagagacctcgagatgaggatgatgctgattataaacctaagaaaattaaaacagaagataccaagaaggagaagaaaagaaaactagaagaagaagaggatggtaaattgaaaaaacccaagaataaagataaagataaaaaagttcctgagccagataacaagaaaaagaagccgaagaaagaagaggaacagaagtggaaatggtgggaagaagagcgctatcctgaaggcatcaagtggaaattcctagaacataaaggtccagtatttgccccaccatatgagcctcttccagagaatgtcaagttttattatgatggtaaagtcatgaagctgagccccaaagcagaggaagtagctacgttctttgcaaaaatgctcgaccatgaatatactaccaaggaaatatttaggaaaaatttctttaaagactggagaaaggaaatgactaatgaagagaagaatattatcaccaacctaagcaaatgtgattttacccagatgagccagtatttcaaagcccagacggaagctcggaaacagatgagcaaggaagagaaactgaaaatcaaagaggagaatgaaaaattactgaaagaatatggattctgtattatggataaccacaaagagaggattgctaacttcaagatagagcctcctggacttttccgtggccgcggcaaccaccccaagatgggcatgctgaagagacgaatcatgcccgaggatataatcatcaactgtagcaaagatgccaaggttccttctcctcctccaggacataagtggaaagaagtccggcatgataacaaggttacttggctggtttcctggacagagaacatccaaggttccattaaatacatcatgcttaaccctagttcacgaatcaagggtgagaaggactggcagaaatacgagactgctcggcggctgaaaaaatgtgtggacaagatccggaaccagtatcgagaagactggaagtccaaagagatgaaagtccggcagagagctgtagccctgtacttcatcgacaagcttgctctgagagcaggcaatgaaaaggaggaaggagaaacagcggacactgtgggctgctgctcacttcgtgtggagcacatcaatctacacccagagttggatggtcaggaatatgtggtagagtttgacttcctcgggaaggactccatcagatactataacaaggtccctgttgagaaacgagtttttaagaacctacaactatttatggagaacaagcagcccgaggatgatctttttgatagactcaatactggtattctgaataagcatcttcaggatctcatggagggcttgacagccaaggtattccgtacatacaatgcctccatcacgctacagcagcagctaaaagaactgacagccccggatgagaacatcccagcgaagatcctttcttataaccgtgccaatcgagctgttgcaattctttgtaaccatcagagggcaccaccaaaaacttttgagaagtctatgatgaacttgcaaactaagattgatgccaagaaggaacagctagcagatgcccggagagacctgaaaagtgctaaggctgatgccaaggtcatgaaggatgcaaagacgaagaaggtagtagagtcaaagaagaaggctgttcagagactggaggaacagttgatgaagctggaagttcaagccacagaccgagaggaaaataaacagattgccctgggaacctccaaactcaattatctggaccctaggatcacagtggcttggtgcaagaagtggggtgtcccaattgagaagatttacaacaaaacccagcgggagaagtttgcctgggccattgacatggctgatgaagactatgagttttagccagtctcaagaggcagagttctgtgaagaggaacagtgtggtttgggaaagatggataaactgagcctcacttgccctcgtgcctgggggagagaggcagcaagtcttaacaaaccaacatctttgcgaaaagataaacctggagatattataagggagagctgagccagttgtcctatggacaacttatttaaaaatatttcagatatcaaaattctagctgtatgatttgttttgaattttgtttttattttcaagagggcaagtggatgggaatttgtcagcgttctaccaggcaaattcactgtttcactgaaatgtttggattctcttagctactgtatgcaaagtccgattatattggtgcgtttttacagttagggttttgcaataacttctatattttaatagaaataaattcctaaactcccttccctctctcccatttcaggaatttaaaattaagtagaacaaaaaacccagcgcacctgttagagtcgtcactctctattgtcatggggatcaattttcattaaacttgaagcagtcgtggctttggcagtgttttggttcagacacctgttcacagaaaaagcatgatgggaaaatatttcctgacttgagtgttcctttttaaatgtgaatttttatttctttttaattattttaaaatatttaaacctttttcttgatcttaaagatcgtgtagattggggttggggagggatgaagggcgagtgaatctaaggataatgaaataatcagtgactgaaaccattttcccatcatcctttgttctgagcattcgctgtaccctttaagatatccatctttttctttttaaccctaatctttcacttgaaagattttattgtataaaaagtttcacaggtcaataaacttagaggaaaatgagtatttggtccaaaaaaaggaaaaataatcaagattttagggcttttattttttcttttgtaattgtgtaaaaaatggaaaaaaacataaaaagcagaattttaatgtgaagacattttttgctataatcattagttttagaggcattgttagtttagtgtgtgtgcagagtccatttcccacatctttcctcaagtatcttctatttttatcatgaattcccttttaatcaactgtaggttatttaaaataaattcctacaacttaatggaaa

SEQ ID NO: 634 - DNA, 6704 bp, Homo sapiens; identical to SEQ ID NO: 320

SEQ ID NO: 635 - DNA, 2447 bp, Homo sapiens
gctttttgaccccggaagtccgggcgggcgccgagccgggtgcgttttgccacagagccgtaaaggcgcgcgggaacatggggctgtatgctgcagctgcaggcgtgttggccggcgtggagagccgccagggctctatcaaggggttggtgtactccagcaacttccagaacgtgaagcagctgtacgcgctggtgtgcgaaacgcagcgctactccgccgtgctggatgctgtgatcgccagcgccggcctcctccgtgcggagaagaagctgcggccgcacctggccaaggtgctagtgtatgagttgttgttgggaaagggctttcgagggggtgggggccgatggaaggctctgttgggccggcaccaggcgaggctcaaggctgagttggctcggctcaaggttcatcggggtgtgagccggaatgaggacctgttggaagtgggatccaggcctggtccagcctcccagctgcctcgatttgtgcgtgtgaacactctcaagacctgctccgatgatgtagttgattatttcaagagacaaggtttctcctatcagggtcgggcttccagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggaccccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcccgggctggcgtctcttgctgtgaactggctgaggaggacttcctggcggtctccccctcggatccacgctaccatgaggtccactacatcctgctggatccttcctgcagtggctcgggtatgccgagcagacagctggaggagcccggggcaggcacacctagcccggtgcgtctgcatgccctggcagggttccagcagcgagccctgtgccacgcactcactttcccttccctgcagcggctcgtctactccacgtgctccctctgccaggaggagaatgaagacgtggtgcgagatgcgctgcagcagaacccgggcgccttcaggctagctcccgccctgcctgcctggccccaccgaggcctgagcacgttcccgggtgccgagcactgcctccgggcctcccctgagaccacactcagcagtggcttcttcgttgctgtaattgaacgggtcgaggtgccaaggtgagtgagtgggggcgtgcttgggaggcgcaggatggcaccggcacatctaacatctacacttctctagctcagcctcacaggccaaagcatcagcaccagaacgcacacccagcccagccccaaagagaaagaagagacagcaaagagccgcagccggtgcttgcacaccgccttgcacatagcagaggctccgggctgactccttcctggtgggaaaggaagatgcctgtcctctccgtggaggaccctgggccctcaccgcaggaagcagtttgggttttgaaaggttattgggtcccttccttgggctgtgttcttgctggtgagcaaagtgttgcctgcaaaaataaaatgcagaacgtactctacgatagatcacagttttttattcttaatgtcacaagcaggagaaaaatctcacattcatactaaaagttccaactagactcaacaggaatgaagtctctatttgtaatggaaagtcccagcctcccgctgccgtccagtgcgtgtactgtacacatccacactcacactcactcagggttcccggaccggctgtcctgcctgcggaactgaggtaaactagctcaggtgctgacactaggagggtctaccttacataaggtacaggtagaagcttgattgctaggcccaggcccacccagaccctccaatcctaacaggtatttaggcttgaggttcactccctcctcagctgcacacgcagccaggtattaacgaggatcagagctgttctgaggggtgggaaggagcagccccaccaccactcactcaccctcagtcacatcggggagggggcaccagttacatttacatcacattatttataaaataagaattacatttcatataacatggccagaaggagctctagtcccccaggaaagctgccggggacagcatttgagcctcttctttgcacaggcataacttaactatacagctaattcctagttaatagcatttatacttaaccacctcaatgaaccaagcttgaaggaatttaaaaggcaatttagcttaaatacaaaaataaatttttgttaaaaaacgttta

SEQ ID NO: 636 - DNA, 5400 bp, Homo sapiens
atctaatcagggacgctgggctgggaactgtccaatcaggcacaaagctggagcggacagggcggcttccgggatgtggctgggcctttgtctctcgctgccgccggagtttccaggtctcgacttcactgctctgtgtcctctgctccaggaggcccagcctgtgtggccctgtgacctgcaggtattggagagccacagctaagatgccaggaacccctggaagcctagaaatgggactgttgacatttagggatgtggccatagaattctctccggaggagtggcaatgtctggacactgcacagcagaatttatataggaatgtgatgttagagaactacagaaacctggccttcctgggtatatgtcctcattttcctcaagacttttggccagagcagagcatggaagattcttttcaaaaagtattactgagaaaatatgaaaaatgtggacatgagaatttacagttaagaaaaggttgtaaaagtgtggatgagtgtaaggtgcacaaagaaggttataataaacttaaccagtgtctcacaactgcccagagcaaagtatttcaatgtgggaaatatttgaaagtcttctataaatttttaaattcaaacagacatacgataagacatactggaaagaaatgcttcaaatgtaaaaaatgtgtcaagtcattttgcatccgtttacacaaaacccaacataaatgcgtttatattacagagaagtcctgtaaatgtaaagaatgtgaaaaaacctttcattggtcctcaacccttactaatcataaggaaattcatactgaagataaaccctacaaatgtgaagaatgtggcaaagcttttaagcagctctcaacccttactacacataaaataatctgtgctaaagagaaaatctacaagtgtgaagaatgtggcaaagcatttctatggtcctcaaccctaactagacataagaggatacacactggagagaaaccctacaaatgtgaagaatgtggcaaagcttttagccattcttcaacccttgctaaacataagagaattcatactggagagaaaccctacaaatgtgaagaatgtggcaaagcttttagccgttcttcaacccttgctaaacataagagaattcatactggagagaaaccctacaaatgtaaagaatgtggcaaagcttttagcaattcctcaacccttgctaatcataagataactcatactgaagagaaaccctacaaatgtaaagaatgtgacaaagcttttaagcgactctcaacccttactaaacataaaataatacatgctggagagaaactctacaaatgtgaagaatgtggcaaagcttttaatcgatcttcaaatcttactatacataagtttattcatactggagagaaaccttacaagtgtgaagaatgtggcaaagcatttaactggtcctcaagccttactaaacataaaagatttcatactagagagaaacccttcaaatgtaaagaatgtggcaaagcatttatatggtcttcaaccctaactagacataagaggatacacactggagagaagccctacaaatgtgaagaatgtggcaaagcttttaggcaatcctcaacccttactaaacataagataattcatactggagagaaaccctacaaatttgaagaatgtggcaaagcttttagacaatccttaacccttaataaacataagataattcatagtagagagaaaccctacaaatgtaaagaatgtggcaaagcttttaagcaattctcaacccttactacacataaaataattcatgctggaaagaaactctacaaatgtgaagaatgtggcaaagcttttaatcattcctcaagtctttctacacataagataattcatactggagagaagtcttacaagtgtgaagaatgtggcaaagcatttctatggtcctcaaccctaagaagacataagaggatacacactggagagaaaccctacaaatgtgaagaatgtggcaaagcttttagccattcttcagcccttgctaaacataagagaattcatactggagagaaaccctacaaatgtaaagaatgtggcaaagcttttagcaattcctcaacccttgctaatcataagataactcatactgaagagaaaccctacaaatgtaaagaatgtgacaaaacttttaagcgactctcaacccttactaaacataaaataatacatgctggagagaaactctacaaatgtgaagaatgtggcaaagcttttaatcgatcttcaaatcttactatacataagtttattcatactggagagaaaccttacaagtgtgaagaatgtggcaaagcatttaactggtcctcaagccttactaaacataaaagaattcatactagagagaaacccttcaaatgtaaagaatgtggcaaagcatttatatggtcttcaaccctaactagacataagaggatacacactggagagaagccctacaaatgtgaagaatgtggcaaagcttttagccgttcctcaacccttactaagcataagacaattcatactggagagaaaccctacaaatgtaaagaatgtggcaaagcttttaagcactcctcagcccttgctaaacataaaataatacatgctggagagaaactctacaaatgtgaggaatgtggcaaagcttttaatcaatcttcaaatcttacgacacataagataattcatactaaagagaaaccttccaagagtgaagaatgtgacaaagcatttatctggtcctcaacccttactgaacataagagaattcataccagagagaaaacctacaaatgtgaagaatgtggcaaagcatttagccagccttcacaccttactacacataagaggatgcacactggagagaaaccctacaaatgtgaagaatgtggcaaagcttttagccaatcctcaacccttactacacataagataattcatactggagagaaaccctacaaatgtgaagaatgtggcaaagcttttaggaaatcttcaactcttactgaacataagataattcatactggagagaaaccctacaaatgtgaagaatgtggcaaagcatttagccaatcctcaaccctaactagacatacgaggatgcacactggagagaaaccatacaaatgtgaagaatgtggcaaagcttttaatcgatcctcaaagcttactacacataagataattcatactggagagaaaccttacaagtgtgaagaatgtggcaaagcatttatatcatcctcaaccctaaatggacataagagaattcatactagagagaaaccctacaaatgtgaagaatgtggcaaagcatttagccaatcttcaaccctaactagacataagaggttgcacaccggagagaaaccctacaaatgtggagaatgtggcaaagcctttaaagagtcctcagctcttactaaacataagataattcacactggagagaaaccctacaaatgtgaaaaatgtggcaaagcctttaaccagtcttcaatccttactaaccataagaaaattcatactatcacacctgtaatcccactactttgggaggccgaggcgggcggatcacgaggtcaggagatggagaccatcctggctaacacagtgaaaccccttctctactaaaaaatacaaaaaattagccgggcgtggtggcgggcgcctgtagtcccagctatgcgagaggctgaggcaggagaatggcgtgaacccgggaggcggagcttgcagtgagccgagatcacgccactgcactcaagcctgggcgacagagcgagactccgtctcaaaaaaaaaaaaaagaaaattcatactagagagaaaccctacaaatataaagaatgtggcaaatcttttaaccggtcttcaacctttactaaacataaggtaattcatactggagtaaaactctacaaatgtgaagaatgtggcaaatcctttttctggtcctcagccctaaccagacataagaaaattcatactggacagcaaccctacaaacaggaaaaatttggcaaagcctttaaccagttttcacaccttactacagataagataactcatattggagagaaatcttacaagtgtgaataatgtggtaaagtctataaaaagtcctgaattcttaacagacataatattattcatactggagagaaactctacaaacctgaaagatgtgccaacgcttttgacaagtcaaacttttctaaacatcaagaaaatcatgctgctgagaaatcctagaaatgtgaagaatgtgacaaagcctctaaatgattgtcacacttgatcgtaggtaagataattcatactggagaaaactaccagtgtgaacaatgtggccaagctttgaactaatgctcacaccttaatgcataggaaagcatttatgcttgagaaaaagtgaacaaatatagacaaaaagccattaatacctgctcacatcgtactcaaattcagagcgttcatactaaataagaagtgtaattactgtcaaacgactgatcagaaaatatgtctttaaagtacagaagagtattttgaaaaagcattacaaatatgaagaggcattatttatgaccttttctatggaaaggtaaggacattaaaaatgtaagatgcatgatgaaaatttaagtagagaggatctttatggttaacttataatatcgagtgatgcatgaggtagatgttcagattaatattctgcattattatgaaagaaaaacattcttaattttagttaaagtttagtatgatttattgtatttttatgaaatatatgtagcatatttttaaattataaattgcatgtgaacttttcaaccaaacagttttaacatgttaaatactatcatgaattcaatgaagtgttattatgccagtaactttaacctattccaccttactcaagggtgtaggtaaaagatggtaaaaatacactatttggtaagataatggactgacatctctagtgattttttttgccagtgagttttaattgccattaagttaaagaatattgttcccataggctaaatttttatttttattttctcatttaaatgtatttgacttaatttttgtggatacctaatatgtgtacatattatgccatatgtggcatattttgatacggacacacaatatataacaatcgcattagactaaatgcggtctccattacctctagcatttattctttgtattacaaataattcaattctacagttttagttatttttaaatgtacaattaaattgttgttgactacaggattatttttatggtcataataaaacttatatacaaacataagtaaaatccataaaaaaaa

SEQ ID NO: 637-638 - skipped (2 entries)

SEQ ID NO: 639 - protein, 1682 aa, Human
MHRAVDPPGARAAREAFALGGLSCAGAWSSCPPHPPPRSAWLPGGRCSASIGQPPLPAPLPPSHGSSSGHPSKPYYAPGAPTPRPLHGKLESLHGCVQALLREPAQPGLWEQLGQLYESEHDSEEATRCYHSALRYGGSFAELGPRIGRLQQAQLWNFHTGSCQHRAKVLPPLEQVWNLLHLEHKRNYGAKRGGPPVKRAAEPPVVQPVPPAALSGPSGEEGLSPGGKRRRGCNSEQTGLPPGLPLPPPPLPPPPPPPPPPPPPLPGLATSPPFQLTKPGLWSTLHGDAWGPERKGSAPPERQEQRHSLPHPYPYPAPAYTAHPPGHRLVPAAPPGPGPRPPGAESHGCLPATRPPGSDLRESRVQRSRMDSSVSPAATTACVPYAPSRPPGLPGTTTSSSSSSSSNTGLRGVEPNPGIPGADHYQTPALEVSHHGRLGPSAHSSRKPFLGAPAATPHLSLPPGPSSPPPPPCPRLLRPPPPPAWLKGPACRAAREDGEILEELFFGTEGPPRPAPPPLPHREGFLGPPASRFSVGTQDSHTPPTPPTPTTSSSNSNSGSHSSSPAGPVSFPPPPYLARSIDPLPRPPSPAQNPQDPPLVPLTLALPPAPPSSCHQNTSGSFRRPESPRPRVSFPKTPEVGPGPPPGPLSKAPQPVPPGVGELPARGPRLFDFPPTPLEDQFEEPAEFKILPDGLANIMKMLDESIRKEEEQQQHEAGVAPQPPLKEPFASLQSPFPTDTAPTTTAPAVAVTTTTTTTTTTTATQEEEKKPPPALPPPPPLAKFPPPSQPQPPPPPPPSPASLLKSLASVLEGQKYCYRGTGAAVSTRPGPLPTTQYSPGPPSGATALPPTSAAPSAQGSPQPSASSSSQFSTSGGPWARERRAGEEPVPGPMTPTQPPPPLSLPPARSESEVLEEISRACETLVERVGRSATDPADPVDTAEPADSGTERLLPPAQAKEEAGGVAAVSGSCKRRQKEHQKEHRRHRRACKDSVGRRPREGRAKAKAKVPKEKSRRVLGNLDLQSEEIQGREKSRPDLGGASKAKPPTAPAPPSAPAPSAQPTPPSASVPGKKAREEAPGPPGVSRADMLKLRSLSEGPPKELKIRLIKVESGDKETFIASEVEERRLRMADLTISHCAADVVRASRNAKVKGKFRESYLSPAQSVKPKINTEEKLPREKLNPPTPSIYLESKRDAFSPVLLQFCTDPRNPITVIRGLAGSLRLNLGLFSTKTLVEASGEHTVEVRTQVQQPSDENWDLTGTRQIWPCESSRSHTTIAKYAQYQASSFQESLQEEKESEDEESEEPDSTTGTPPSSAPDPKNHHIIKFGTNIDLSDAKRWKPQLQELLKLPAFMRVTSTGNMLSHVGHTILGMNTVQLYMKVPGSRTPGHQENNNFCSVNINIGPGDCEWFAVHEHYWETISAFCDRHGVDYLTGSWWPILDDLYASNIPVYRFVQRPGDLVWINAGTVHWVQATGWCNNIAWNVGPLTAYQYQLALERYEWNEVKNVKSIVPMIHVSWNVARTVKISDPDLFKMIKFCLLQSMKHCQVQRESLVRAGKKIAYQGRVKDEPAYYCNECDVEVFNILFVTSENGSRNTYLVHCEGCARRRSAGLQGVVVLEQYRTEELAQAYDAFTLVRARRARGQRRRALGQAAGTGFGSPAAPFPEPPPAFSPQAPASTSR

SEQ ID NO: 640 - protein, 855 aa, Human
MSAPSEEEEYARLVMEAQPEWLRAEVKRLSHELAETTREKIQAAEYGLAVLEEKHQLKLQFEELEVDYEAIRSEMEQLKEAFGQAHTNHKKVAADGESREESLIQESASKEQYYVRKVLELQTELKQLRNVLTNTQSENERLASVAQELKEINQNVEIQRGRLRDDIKEYKFREARLLQDYSELEEENISLQKQVSVLRQNQVEFEGLKHEIKRLEEETEYLNSQLEDAIRLKEISERQLEEALETLKTEREQKNSLRKELSHYMSINDSFYTSHLHVSLDGLKFSDDAAEPNNDAEALVNGFEHGGLAKLPLDNKTSTPKKEGLAPPSPSLVSDLLSELNISEIQKLKQQLMQMEREKAGLLATLQDTQKQLEHTRGSLSEQQEKVTRLTENLSALRRLQASKERQTALDNEKDRDSHEDGDYYEVDINGPEILACKYHVAVAEAGELREQLKALRSTHEAREAQHAEEKGRYEAEGQALTEKVSLLEKASRQDRELLARLEKELKKVSDVAGETQGSLSVAQDELVTFSEELANLYHHVCMCNNETPNRVMLDYYREGQGGAGRTSPGGRTSPEARGRRSPILLPKGLLAPEAGRADGGTGDSSPSPGSSLPSPLSDPRREPMNIYNLIAIIRDQIKHLQAAVDRTTELSRQRIASQELGPAVDKDKEALMEEILKLKSLLSTKREQITTLRTVLKANKQTAEVALANLKSKYENEKAMVTETMMKLRNELKALKEDAATFSSLRAMFATRCDEYITQLDEMQRQLAAAEDEKKTLNSLLRMAIQQKLALTQRLELLELDHEQTRRGRAKAAPKTKPATPSVSHTCACASDRAEGTGLANQVFCSEKHSIYCD

SEQ ID NO: 641 - protein, 470 aa, Human
MGLYAAAAGVLAGVESRQGSIKGLVYSSNFQNVKQLYALVCETQRYSAVLDAVIASAGLLRAEKKLRPHLAKVLVYELLLGKGFRGGGGRWKALLGRHQARLKAELARLKVHRGVSRNEDLLEVGSRPGPASQLPRFVRVNTLKTCSDDVVDYFKRQGFSYQGRASSLDDLRALKGKHFLLDPLMPELLVFPAQTDLHEHPLYRAGHLILQDRASCLPAMLLDPPPGSHVIDACAAPGNKTSHLAALLKNQGKIFAFDLDAKRLASMATLLARAGVSCCELAEEDFLAVSPSDPRYHEVHYILLDPSCSGSGMPSRQLEEPGAGTPSPVRLHALAGFQQRALCHALTFPSLQRLVYSTCSLCQEENEDVVRDALQQNPGAFRLAPALPAWPHRGLSTFPGAEHCLRASPETTLSSGFFVAVIERVEVPSLTGQSISTRTHTQPSPKEKEETAKSRSRCLHTALHIAEAPG

SEQ ID NO: 642 - protein, 1219 aa, Human
MPKIVLNGVTVDFPFQPYKCQQEYMTKVLECLQQKVNGILESPTGTGKTLCLLCTTLAWREHLRDGISARKIAERAQGELFPDRALSSWGNAAAAAGDPIACYTDIPKIIYASRTHSQLTQVINELRNTSYRPKVCVLGSREQLCIHPEVKKQESNHLQIHLCRKKVASRSCHFYNNVEEKSLEQELASPILDIEDLVKSGSKHRVCPYYLSRNLKQQADIIFMPYNYLLDAKSRRAHNIDLKGTVVIFDEAHNVEKMCEESASFDLTPHDLASGLDVIDQVLEEQTKAAQQGEPHPEFSADSPSPGLNMELEDIAKLKMILLRLEGAIDAVELPGDDSGVTKPGSYIFELFAEAQITFQTKGCILDSLDQIIQHLAGRAGVFTNTAGLQKLADIIQIVFSVDPSEGSPGSPAGLGALQSYKVHIHPDAGHRRTAQRSDAWSTTAARKRGKVLSYWCFSPGHSMHELVRQGVRSLILTSGTLAPVSSFALEMQIPFPVCLENPHIIDKHQIWVGVVPRGPDGAQLSSAFDRRFSEECLSSLGKALGNIARVVPYGLLIFFPSYPVMEKSLEFWRARDLARKMEALKPLFVEPRSKGSFSETISAYYARVAAPGSTGATFLAVCRGKASEGLDFSDTNGRGVIVTGLPYPPRMDPRVVLKMQFLDEMKGQGGAGGQFLSGQEWYRQQASRAVNQAIGRVIRHRQDYGAVFLCDHRFAFADARAQLPSWVRPHVRVYDNFGHVIRDVAQFFRVAERTMPAPAPRATAPSVRGEDAVSEAKSPGPFFSTRKAKSLDLHVPSLKQRSSGSPAAGDPESSLCVEYEQEPVPARQRPRGLLAALEHSEQRAGSPGEEQAHSCSTLSLLSEKRPAEEPRGGRKKIRLVSHPEEPVAGAQTDRAKLFMVAVKQELSQANFATFTQALQDYKGSDDFAALAACLGPLFAEDPKKHNLLQGFYQFVRPHHKQQFEEVCIQLTGRGCGYRPEHSIPRRQRAQPVLDPTGRTAPDPKLTVSTAAAQQLDPQEHLNQGRPHLSPRPPPTGDPGSQPQWGSGVPRAGKQGQHAVSAYLADARRALGSAGCSQLLAALTAYKQDDDLDKVLAVLAALTTAKPEDFPLLHRFSMFVRPHHKQRFSQTCTDLTGRPYPGMEPPGPQEERLAVPPVLTHRAPQPGPSRSEKTGKTQSKISSFLRQRPAGTVGAGGEDAGPSQSSGPPHGPAASEWGL

SEQ ID NO: 643 - protein, 581 aa, Human
MPRRKRNAGSSSDGTEDSDFSTDLEHTDSSESDGTSRRSARVTRSSARLSQSSQDSSPVRNLQSFGTEEPAYSTRRVTRSQQQPTPVTPKKYPLRQTRSSGSETEQVVDFSDRETKNTADHDESPPRTPTGNAPSSESDIDISSPNVSHDESIAKDMSLKDSGSDLSHRPKRRRFHESYNFNMKCPTPGCNSLGHLTGKHERHFSISGCPLYHNLSADECKAPTERQLRYKEKVAELRKKRNSGLSKEQKEKYMEHRQTYGNTREPLLENLTSEYDLDLFRRAQARASEDLEKLRLQGQITEGSNMIKTIAFGRYELDTWYHSPYPEEYARLGRLYMCEFCLKYMKSQTILRRHMAKCVWKHPPGDEIYRKGSISVFEVDGKKNKIYCQNLCLLAKLFLDHKTLYYDVEPFLFYVMTEADNTGCHLIGYFSKEKNSFLNYNVSCILTMPQYMRQGYGKMLIDFSYLLSKVEEKVGSPERPLSDLGLISYRSYWKEVLLRYLHNFQGKEISIKEISQETAVNPVDIVSTLQALQMLKYWKGKHLVLKRQDLIDEWIAKEAKRSNSNKTMDPSCLKWTPPKGT

SEQ ID NO: 644 - protein, 324 aa, Human
MDAPRQVVNFGPGPAKLPHSVLLEIQKELLDYKGVGISVLEMSHRSSDFAKIINNTENLVRELLAVPDNYKVIFLQGGGCGQFSAVPLNLIGLKAGRCADYVVTGAWSAKAAEEAKKFGTINIVHPKLGSYTKIPDPSTWNLNPDASYVYYCANETVHGVEFDFIPDVKGAVLVCDMSSNFLSKPVDVSKFGVIFAGAQKNVGSAGVTVVIVRDDLLGFALRECPSVLEYKVQAGNSSLYNTPPCFSIYVMGLVLEWIKNNGGAAAMEKLSSIKSQTIYEIIDNSQGFYVSVGGIRASLYNAVTIEDVQKLAAFMKKFLEMHQL

SEQ ID NO: 645 - protein, 313 aa, Human
MSDLLLLGLIGGLTLLLLLTLLAFAGYSGLLAGVEVSAGSPPIRNVTVAYKFHMGLYGETGRLFTESCSISPKLRSIAVYYDNPHMVPPDKCRCAVGSILSEGEESPSPELIDLYQKFGFKVFSFPAPSHVVTATFPYTTILSIWLATRRVHPALDTYIKERKLCAYPRLEIYQEDQIHFMCPLARQGDFYVPEMKETEWKWRGLVEAIDTQVDGTGADTMSDTSSVSLEVSPGSRETSAATLSPGASSRGWDDGDTRSEHSYSESGASGSSFEELDLEGEGPLGESRLDPGTEPLGTTKWLWEPTAPEKGKE

SEQ ID NO: 646 - protein, 475 aa, Human [sequence omitted]

SEQ ID NO: 647 - protein, 718 aa, Human
MLVHLFRVGIRGGPFPGRLLPPLRFQTFSAVRYSDGYRSSSLLRAVAHLRSQLWAHLPRAPLAPRWSPSAWCWVGGALLGPMVLSKHPHLCLVALCEAEEAPPASSTPHVVGSRFNWKLFWQFLHPHLLVLGVAVVLALGAALVNVQIPLLLGQLVEVVAKYTRDHVGSFMTESQNLSTHLLILYGVQGLLTFGYLVLLSHVGERMAVDMRRALFSSLLRQDITFFDANKTGQLVSRLTTDVQEFKSSFKLVISQGLRSCTQVAGCLVSLSMLSTRLTLLLMVATPALMGVGTLMGSGLRKLSRQCQEQIARAMGVADEALGNVRTVRAFAMEQREEERYGAELEACRCRAEELGRGIALFQGLSNIAFNCMVLGTLFIGGSLVAGQQLTGGDLMSFLVASQTVQRSMANLSVLFGQVVRGLSAGARVFEYMALNPCIPLSGGCCVPKEQLRGSVTFQNVCFSYPCRPGFEVLKDFTLTLPPGKIVALVGQSGGGKTTVASLLERFYDPTAGVVMLDGRDLRTLDPSWLRGQVVGFISQEPVLFGTTIMENIRFGKLEASDEEVYTAAREANAHEFITSFPEGYNTVVGERGTTLSGGQKQRLAIARALIKQPTVLILDEATSALDAESERVVQEALDRASAGRTVLVIAHRLSTVRGAHCIVVMADGRVWEAGTHEELLKKGGLYAELIRRQALDAPRTAAPPPKKPEGPRSHQHKS

SEQ ID NO: 648 - protein, 362 aa, Human
MQAERGARGGRGRRPGRGRPGGDRHSERPGAAAAVARGGGGGGGGDGGGRRGRGRGRGFRGARGGRGGGGAPRGSRREPGGWGAGASAPVEDDSDAETYGEENDEQGNYSKRKIVSNWDRYQDIEKEVNNESGESQRGTDFSVLLSSAGDSFSQFRFAEEKEWDSEASCPKQNSAFYVDSELLVRALQELPLCLRLNVAAELVQGTVPLEVPQVKPKRTDDGKGLGMQLKGPLGPGGRGPIFELKSVAAGCPVLLGKDNPSPGPSRDSQKPTSPLQSAGDHLEEELDLLLNLDAPIKEGDNILPDQTSQDLKSKEDGEVVQEEEVCAKPSVTEEKNMEPEQPSTSKNVTEEELEDWLDSMIS

SEQ ID NO: 649 - protein, 188 aa, Human
MSPLLRRLLLAALLQLAPAQAPVSQPDAPGHQRKVVSWIDVYTRATCQPREVVVPLTVELMGTVAKQLVPSCVTVQRCGGCCPDDGLECVPTGQHQVRMQILMIRYPSSQLGEMSLEEHSQCECRPKKKDSAVKPDSPRPLCPRCTQHHQRPDPRTCRCRCRRRSFLRCQGRGLELNPDTCRCRKLRR

SEQ ID NO: 650 - protein, 201 aa, Human
MITETAAEPTVPAVPAAEEATEARGREEPAWPWKDAPIRTLVQRIHQLQAERAQGFRRLEEWLAPVQGLRAWGRGLRVPTCRRGHRQYLRSGPDYDFARYRSTVHGVTQAFAAASREVLAVEAELGGPRRQPLLAGHVRSLQELEQTRLGTVALLQLMETPELAGQEDAVRMQQLKMKVIKTMEAISEVLQDLRFDAESAE

SEQ ID NO: 651 - protein, 114 aa, Human
MGPRRRSRKPEAPRRRSPSPTPTPGPSRRGPSLGASSHQHSRRRQGWLKEIRKLQKSTHLLIRKLPFSRLAAEAFLVHLFEDAYLLTLHAGRVTLFPKDVQLARRIRGLEEGLG

SEQ ID NO: 652 - protein, 943 aa, Human
MAASGLDHLKNGYRRRFCRPSRARDINTEQGQNVLEILQDCFEEKSLANDFSTNSTKSVPNSTRKIKDTCIQSPSKECQKSHPKSVPVSSKKKEASLQFVVEPSEATNRSVQAHEVHQKILATDVSSKNTPDSKKISSRNINDHHSEADEEFYLSVGSPSVLLDAKTSVSQNVIPSSAQKRETYTFENSVNMLPSSTEVSVKTKKRLNFDDKVMLKKIEIDNKVSDEEDKTSEGQERKPSGSSQNRIRDSEYEIQRQAKKSFSTLFLETVKRKSESSPIVRHAATAPPHSCPPDDTKLIEDEFIIDESDQSFASRSWITIPRKAGSLKQRTISPAESTALLQGRKSREKHHNILPKTLANDKHSHKPHPVETSQPSDKTVLDTSYALIGETVNNYRSTKYEMYSKNAEKPSRSKRTIKQKQRRKFMAKPAEEQLDVGQSKDENIHTSHITQDEFQRNSDRNMEEHEEMGNDCVSKKQMPPVGSKKSSTRKDKEESKKKRFSSESKNKLVPEEVTSTVTKSRRISRRPSDWWVVKSEESPVYSNSSVRNELPMHHNSSRKSTKKTNQSSKNIRKKTIPLKRQKTATKGNQRVQKFLNAEGSGGIVGHDEISRCSLSEPLESDEADLAKKKNLDCSRSTRSSKNEDNIMTAQNVPLKPQTSGYTCNIPTESNLDSGEHKTSVLEESGPSRLNNNYLMSGKNDVDDEEVHGSSDDSKQSKVIPKNRIHHKLVLPSNTPNVRRTKRTRLKPLEYWRGERIDYQGRPSGGFVISGVLSPDTISSKRKAKENIGKVNKKSNKKRICLDNDERKTNLMVNLGIPLGDPLQPTRVKDPETREIILMDLVRPQDTYQFFVKHGELKVYKTLDTPFFSTGKLILGPQEEKGKQHVGQDILVFYVNFGDLLCTLHETPYILSTGDSFYVPSGNYYNIKNLRNEESVLLFTQIKR

SEQ ID NO: 653 - protein, 561 aa, Human
MADHNPDSDSTPRTLLRRVLDTADPRTPRRPRSARAGARRALLETASPRKLSGQTRTIARGRSHGARSVGRSAHIQASGHLEEQTPRTLLKNILLTAPESSILMPESVVKPVPAPQAVQPSRQESSCGSLELQLPELEPPTTLAPGLLAPGRRKQRLRLSVFQQGVDQGLSLSQEPQGNADASSLTRSLNLTFATPLQPQSVQRPGLARRPPARRAVDVGAFLRDLRDTSLAPPNIVLEDTQPFSQPMVGSPNVYHSLPCTPHTGAEDAEQAAGRKTQSSGPGLQKNSPGKPAQFLAGEAEEVNAFALGFLSTSSGVSGEDEVEPLHDGVEEAEKKMEEEGVSVSEMEATGAQGPSRVEEAEGHTEVTEAEGSQGTAEADGPGASSGDEDASGRAASPESASSTPESLQARRHHQFLEPAPAPGAAVLSSEPAEPLLVRHPPRPRTTGPRPRQDPHKAGLSHYVKLFSFYAKMPMERKALEMVEKCLDKYFQHLCDDLEVFAAHAGRKTVKPEDLELLMRRQGLVTDQVSLHVLVERHLPLEYRQLLIPCAYSGNSVFPAQ

SEQ ID NO: 654 - protein, 590 aa, Human
MTLHNNSTTSPLFPNISSSWIHSPSDAGLPPGTVTHFGSYNVSRAAGNFSSPDGTTDDPLGGHTVWQVVFIAFLTGILALVTIIGNILVIVSFKVNKQLKTVNNYFLLSLACADLIIGVISMNLFTTYIIMNRWALGNLACDLWLAIDYVASNASVMNLLVISFDRYFSITRPLTYRAKRTTKRAGVMIGLAWVISFVLWAPAILFWQYFVGKRTVPPGECFIQFLSEPTITFGTAIAAFYMPVTIMTILYWRIYKETEKRTKELAGLQASGTEAETENFVHPTGSSRSCSSYELQQQSMKRSNRRKYGRCHFWFTTKSWKPSSEQMDQDHSSSDSWNNNDAAASLENSASSDEEDIGSETRAIYSIVLKLPGHSTILNSTKLPSSDNLQVPEEELGMVDLERKADKLQAQKSVDDGGSFPKSFSKLPIQLESAVDTAKTSDVNSSVGKSTATLPLSFKEATLAKRFALKTRSQITKRKRMSLVKEKKAAQTLSAILLAFIITWTPYNIMVLVNTFCDSCIPKTFWNLGYWLCYINSTVNPVCYALCNKTFRTTFKMLLLCQCDKKKRRKQQYQQRQSVIFHKRAPEQAL

SEQ ID NO: 655 - protein, 440 aa, Human
MGLGVSAEQPAGGAEGFHLHGVQENSPAQQAGLEPYFDFIITIGHSRLNKENDTLKALLKANVEKPVKLEVFNMKTMRVREVEVVPSNMWGGQGLLGASVRFCSFRRASEQVWHVLDVEPSSPAALAGLRPYTDYVVGSDQILQESEDFFTLIESHEGKPLKLMVYNSKSDSCREVTVTPNAAWGGEGSLGCGIGYGYLHRIPTQPPSYHKKPPGTPPPSALPLGAPPPDALPPGPTPEDSPSLETGSRQSDYMEALLQAPGSSMEDPLPGPGSPSHSAPDPDGLPHFMETPLQPPPPVQRVMDPGFLDVSGISLLDNSNASVWPSLPSSTELTTTAVSTSGPEDICSSSSSHERGGEATWSGSEFEVSFLDSPGAQAQADHLPQLTLPDSLTSAASPEDGLSAELLEAQAEEEPASTEGLDTGTEAEGLDSQAQISTTE

SEQ ID NO: 656 - protein, 673 aa, Human
MPLNRTLSMSSLPGLEDWEDEFDLENAVLFEVAWEVANKVGGIYTVLQTKAKVTGDEWGDNYFLVGPYTEQGVRTQVELLEAPTPALKRTLDSMNSKGCKFLAQSEEKPHVVAHFHEWLAGVGLCLCRARRLPVATIFTTHATLLGRYLCAGAVDFYNNLENFNVDKEAGERQIYHRYCMERAAAHCAHVFTTVSQITAIEAQHLLKRKPDIVTPNGLNVKKFSAMHEFQNLHAQSKARIQEFVRGHFYGHLDFNLDKTLYFFIAGRYEFSNKGADVFLEALARLNYLLRVNGSEQTVVAFFIMPARTNNFNVETLKGQAVRKQLWDTANTVKEKFGRKLYESLLVGSLPDMNKMLDKEDFTMMKRAIFATQRQSFPPVCTHNMLDDSSDPILTTIRRIGLFNSSADRVKVIFHPEFLSSTSPLLPVDYEEFVRGCHLGVFPSYYEPWGYTPAECTVMGIPSISTNLSGFGCFMEEHIADPSAYGIYILDRRFRSLDDSCSQLTSFLYSFCQQSRRQRIIQRNRTERLSDLLDWKYLGRYYMSARHMALSKAFPEHFTYEPNEADAAQGYRYPRPASVPPSPSLSRHSSPHQSEDEEDPRNGPLEEDGERYDEDEEAAKDRRNIRAPEWPRRASCTSSTSGSKRNSVDTATSSSLSTPSEPLSPTSSLGEERN

SEQ ID NO: 657 - protein, 1123 aa, Human
MNSPNESADGMSGREPSLEILPRTSLHSIPVTVEVKPVLPRAMPSSMGGGGGGSPSPVELRGALVGSVDPTLREQQLQQELLALKQQQQLQKQLLFAEFQKQHDHLTRQHEVQLQKHLKQQQEMLAAKQQQEMLAAKRQQELEQQRQREQQRQEELEKQRLEQQLLILRNKEKSKESAIASTEVKLRLQEFLLSKSKEPTPGGLNHSLPQHPKCWGAHHASLDQSSPPQSGPPGTPPSYKLPLPGPYDSRDDFPLRKTASEPNLKVRSRLKQKVAERRSSPLLRRKDGTVISTFKKRAVEITGAGPGASSVCNSAPGSGPSSPNSSHSTIAENGFTGSVPNIPTEMLPQHRALPLDSSPNQFSLYTSPSLPNISLGLQATVTVTNSHLTASPKLSTQQEAERQALQSLRQGGTLTGKFMSTSSIPGCLLGVALEGDGSPHGHASLLQHVLLLEQARQQSTLIAVPLHGQSPLVTGERVATSMRTVGKLPRHRPLSRTQSSPLPQSPQALQQLVMQQQHQQFLEKQKQQQLQLGKILTKTGELPRQPTTHPEETEEELTEQQEVLLGEGALTMPREGSTESESTQEDLEEEDEEDDGEEEEDCIQVKDEEGESGAEEGPDLEEPGAGYKKLFSDAQPLQPLQVYQAPLSLATVPHQALGRTQSSPAAPGGMKSPPDQPVKHLFTTGVVYDTFMLKHQCMCGNTHVHPEHAGRIQSIWSRLQETGLLSKCERIRGRKATLDEIQTVHSEYHTLLYGTSPLNRQKLDSKKLLGPISQKMYAVLPCGGIGVDSDTVWNEMHSSSAVRMAVGCLLELAFKVAAGELKNGFAIIRPPGHHAEESTAMGFCFFNSVAITAKLLQQKLNVGKVLIVDWDIHHGNGTQQAFYNDPSVLYISLHRYDNGNFFPGSGAPEEVGGGPGVGYNVNVAWTGGVDPPIGDVEYLTAFRTVVMPIAHEFSPDVVLVSAGFDAVEGHLSPLGGYSVTARCFGHLTRQLMTLAGGRVVLALEGGHDLTAICDASEACVSALLSVELQPLDEAVLQQKPNINAVATLEKVIEIQSKHWSCVQKFAAGLGRSLREAQAGETEEAETVSAMALLSVGAEQAQAAAAREHSPRPAEEPMEQEPAL

SEQ ID NO: 658 - protein, 392 aa, Human
MDLFGDLPEPERSPRPAAGKEAQKGPLLFDDLPPASSTDSGSGGPLLFDDLPPASSGDSGSLATSISQMVKTEGKGAKRKTSEEEKNGSEELVEKKVCKASSVIFGLKGYVAERKGEREEMQDAHVILNDITEECRPPSSLITRVSYFAVFDGHGGIRASKFAAQNLHQNLIRKFPKGDVISVEKTVKRCLLDTFKHTDEEFLKQASSQKPAWKDGSTATCVLAVDNILYIANLGDSRAILCRYNEESQKHAALSLSKEHNPTQYEERMRIQKAGGNVRDGRVLGVLEVSRSIGDGQYKRCGVTSVPDIRRCQLTPNDRFILLACDGLFKVFTPEEAVNFILSCLEDEKIQTREGKSAADARYEAACNRLANKAVQRGSADNVTVMVVRIGH

SEQ ID NO: 659 - protein, 133 aa, Human
MNYMPGTASLIEDIDKKHLVLLRDGRTLIGFLRSIDQFANLVLHQTVERIHVGKKYGDIPRGIFVVRGENVVLLGEIDLEKESDTPLQQVSIEEILEEQRVEQQTKLEAEKLKVQALKDRGLSIPRADTLDEY

SEQ ID NO: 660 - protein, 558 aa, Human
MSNDGRSRNRDRRYDEVPSDLPYQDTTIRTHPTLHDSERAVSADPLPPPPLPLQPPFGPDFYSSDTEEPAIAPDLKPVRRFVPDSWKNFFRGKKKDPEWDKPVSDIRYISDGVECSPPASPARPNHRSPLNSCKDPYGGSEGTFSSRKEADAVFPRDPYGSLDRHTQTVRTYSEKVEEYNLRYSYMKSWAGLLRILGVVELLLGAGVFACVTAYIHKDSEWYNLFGYSQPYGMGGVGGLGSMYGGYYYTGPKTPFVLVVAGLAWITTIIILVLGMSMYYRTILLDSNWWPLTEFGINVALFILYMAAAIVYVNDTNRGGLCYYPLFNTPVNAVFCRVEGGQIAAMIFLFVTMIVYLISALVCLKLWRHEAARRHREYMEQQEINEPSLSSKRKMCEMATSGDRQRDSEVNFKELRTAKMKPELLSGHIPPGHIPKPIVMPDYVAKYPVIQTDDERERYKAVFQDQFSEYKELSAEVQAVLRKFDELDAVMSRLPHHSESRQEHERISRIHEEFKKKKNDPTFLEKKERCDYLKNKLSHIKQRIQEYDKVMNWDVQGYS

SEQ ID NO: 661 - protein, 441 aa, Human
MYSPYCLTQDEFHPFIEALLPHVRAFSYTWFNLQARKRKYFKKHEKRMSKDEERAVKDELLGEKPEIKQKWASRLLAKLRKDIRPEFREDFVLTITGKKPPCCVLSNPDQKGKIRRIDCLRQADKVWRLDLVMVILFKGIPLESTDGERLYKSPQCSNPGLCVQPHHIGVTIKELDLYLAYFVHTPESGQSDSSNQQGDADIKPLPNGHLSFQDCFVTSGVWNVTELVRVSQTPVATASGPNFSLADLESPSYYNINQVTLGRRSITSPPSTSTTKRPKSIDDSEMESPVDDVFYPGTGRSPAAGSSQSSGWPNDVDAGPASLKKSGKLDFCSALSSQGSSPRMAFTHHPLPVLAGVRPGSPRATASALHFPSTSIIQQSSPYFTHPTIRYHHHHGQDSLKEFVQFVCSDGSGQATGQHSQRQAPPLPTGLSASDPGTATF

SEQ ID NO: 662 - protein, 916 aa, Human
MGKAAAPSRGGGCGGRSRGLSSLFTVVPCLSCHTAAPGMSASTSGSGPEPKPQPQPVPEPERGPLSEQVSEAVSEAVPRSEPVSETTSEPEPGAGQPSELLQGSRPGSESSSGVGAGPFTKAASEPLSRAVGSATFLRPESGSLPALKPLPLLRPGQAKTPLGVPMSGTGTTSSAPLALLPLDSFEGWLLKWTNYLKGYQRRWFVLGNGLLSYYRNQGEMAHTCRGTINLSTAHIDTEDSCGILLTSGARSYHLKASSEVDRQQWITALELAKAKAVRVMNTHSDDSGDDDEATTPADKSELHHTLKNLSLKLDDLSTCNDLIAKHGAALQRSLTELDGLKIPSESGEKLKVVNERATLFRITSNAMINACRDFLELAEIHSRKWQRALQYEQEQRVHLEETIEQLAKQHNSLERAFHSAPGRPANPSKSFIEGSLLTPKGEDSEEDEDTEYFDAMEDSTSFITVITEAKEDSRKAEGSTGTSSVDWSSADNVLDGASLVPKGSSKVKRRVRIPNKPNYSLNLWSIMKNCIGRELSRIPMPVNFNEPLSMLQRLTEDLEYHHLLDKAVHCTSSVEQMCLVAAFSVSSYSTTVHRIAKPFNPMLGETFELDRLDDMGLRSLCEQVSHHPPSAAHYVFSKHGWSLWQEITISSKFRGKYISIMPLGAIHLEFQASGNHYVWRKSTSTVHNIIVGKLWIDQSGDIEIVNHKTNDRCQLKFLPYSYFSKEAARKVTGVVSDSQGKAHYVLSGSWDEQMECSKVMHSSPSSPSSDGKQKTVYQTLSAKLLWKKYPLPENAENMYYFSELALTLNEHEEGVAPTDSRLRPDQRLMEKGRWDEANTEKQRLEEKQRLSRRRRLEACGPGSSCSSEEEKEADAYTPLWFEKRLDPLTGEMACVYKGGYWEAKEKQDWHMCPNIF

SEQ ID NO: 663 - protein, 326 aa, Human
MLLSKFGSLAHLCGPGGVDHLPVKILQPAKADKESFEKAYQVGAVLGSGGFGTVYAGSRIADGLPVAVKHVVKERVTEWGSLGGATVPLEVVLLRKVGAAGGARGVIRLLDWFERPDGFLLVLERPEPAQDLFDFITERGALDEPLARRFFAQVLAAVRHCHSCGVVHRDIKDENLLVDLRSGELKLIDFGSGALLKDTVYTDFDGTRVYSPPEWIRYHRYHGRSATVWSLGVLLYDMVCGDIPFEQDEEILRGRLLFRRRVSPECQQLIRWCLSLRPSERPSLDQIAAHPWMLGADGGVPESCDLRLCTLDPDDVASTTSSSESL

SEQ ID NO: 664 - protein, 2135 aa, Human
MPALGPALLQALWAGWVLTLQPLPPTAFTPNGTYLQHLARDPTSGTLYLGATNFLFQLSPGLQLEATVSTGPVLDSRDCLPPVMPDECPQAQPTNNPNQLLLVSPGALVVCGSVHQGVCEQRRLGQLEQLLLRPERPGDTQYVAANDPAVSTVGLVAQGLAGEPLLFVGRGYTSRGVGGGIPPITTRALWPPDPQAAFSYEETAKLAVGRLSEYSHHFVSAFARGASAYFLFLRRDLQAQSRAFRAYVSRVCLRDQHYYSYVELPLACEGGRYGLIQAAAVATSREVAHGEVLFAAFSSAAPPTVGRPPSAAAGASGASALCAFPLDEVDRLANRTRDACYTREGRAEDGTEVAYIEYDVNSDCAQLPVDTLDAYPCGSDHTPSPMASRVPLEATPILEWPGIQLTAVAVTMEDGHTIAFLGDSQGQLHRVYLGPGSDGHPYSTQSIQQGSAVSRDLTFDGTFEHLYVMTQSTLLKVPVASCAQHLDCASCLAHRDPYCGWCVLLGRCSRRSECSRGQGPEQWLWSFQPELGCLQVAAMSPANISREETREVFLSVPDLPPLWPGESYSCHFGEHQSPALLTGSGVMCPSPDPSEAPVLPRGADYVSVSVELRFGAVVIAKTSLSFYDCVAVTELRPSAQCQACVSSRWGCNWCVWQHLCTHKASCDAGPMVASHQSPLVSPDPPARGGPSPSPPTAPKALATPAPDTLPVEPGAPSTATASDISPGASPSLLSPWGPWAGSGSISSPGSTGSPLHEEPSPPSPQNGPGTAVPAPTDFRPSATPEDLLASPLSPSEVAAVPPADPGPEALHPTVPLDLPPATVPATTFPGAMGSVKPALDWLTREGGELPEADEWTGGDAPAFSTSTLLSGDGDSAELEGPPAPLILPSSLDYQYDTPGLWELEEATLGASSCPCVESVQGSTLMPVHVEREIRLLGRNLHLFQDGPGDNECVMELEGLEVVVEARVECEPPPDTQCHVTCQQHQLSYEALQPELRVGLFLRRAGRLRVDSAEGLHVVLYDCSVGHGDCSRCQTAMPQYGCVWCEGERPRCVTREACGEAEAVATQCPAPLIHSVEPLTGPVDGGTRVTIRGSNLGQHVQDVLGMVTVAGVPCAVDAQEYEVSSSLVCITGASGEEVAGATAVEVPGRGRGVSEHDFAYQDPKVHSIFPARGPRAGGTRLTLNGSKLLTGRLEDIRVVVGDQPCHLLPEQQSEQLRCETSPRPTPATLPVAVWFGATERRLQRGQFKYTLDPNITSAGPTKSFLSGGREICVRGQNLDVVQTPRIRVTVVSRMLQPSQGLGRRRRVVPETACSLGPSCSSQQFEEPCHVNSSQLITCRTPALPGLPEDPWVRVEFILDNLVFDFATLNPTPFSYEADPTLQPLNPEDPTMPFRHKPGSVFSVEGENLDLAMSKEEVVAMIGDGPCVVKTLTRHHLYCEPPVEQPLPRHHALREAPDSLPEFTVQMGNLRFSLGHVQYDGESPGAFPVAAQVGLGVGTSLLALGVIIIVLMYRRKSKQALRDYKKVQIQLENLESSVRDRCKKEFTDLMTEMTDLTSDLLGSGIPFLDYKVYAERIFFPGHRESPLHRDLGVPESRRPTVEQGLGQLSNLLNSKLFLTKFIHTLESQRTFSARDRAYVASLLTVALHGKLEYFTDILRTLLSDLVAQYVAKNPKLMLRRTETVVEKLLTNWMSICLYTFVRDSVGEPLYMLFRGIKHQVDKGPVDSVTGKAKYTLNDNRLLREDVEYRPLTLNALLAVGPGAGEAQGVPVKVLDCDTISQAKEKMLDQLYKGVPLTQRPDPRTLDVEWRSGVAGHLILSDEDVTSEVQGLWRRLNTLQHYKVPDGATVALVPCLTKHVLRENQDYVPGERTPMLEDVDEGGIRPWHLVKPSDEPEPPRPRRGSLRGGERERAKAIPEIYLTRLLSMKGTLQKFVDDLFQVILSTSRPVPLAVKYFFDLLDEQAQQHGISDQDTIHIWKTNSLPLRFWINIIKNPQFVFDVQTSDNMDAVLLVIAQTFMDACTLADHKLGRDSPINKLLYARDIPRYKRMVERYYADIRQTVPASDQEMNSVLAELSWNYSGDLGARVALHELYKYINKYYDQIITALEEDGTAQKMQLGYRLQQIAAAVENKVTDL

SEQ ID NO: 665 - protein, 180 aa, Human
MAEASSANLGSGCEEKRHEGSSSESVPPGTTISRVKLLDTMVDTFLQKLVAAGSYQRFTDCYKCFYQLQPAMTQQIYDKFIAQLQTSIREEISDIKEEGNLEAVLNALDKIVEEGKVRKEPACNGTPCGAMCRNRRPRTSSWQMPSWQGGGRWRSCSYRSRPSSRPGRLYTENRGSWLLC

SEQ ID NO: 666 - protein, 314 aa, Human
MATTKRVLYVGGLAEEVDDKVLHAAFIPFGDITDIQIPLDYETEKHRGFAFVEFELAEDAAAAIDNMNESELFGRTIRVNLAKPMRIKEGSSRPVWSDDDWLKKFSGKTLEENKEEEGSEPPKAETQEGEPIAKKARSNPQVYMDIKIGNKPAGRIQMLLRSDVVPMTAENFRCLCTHEKGFGFKGSSFHRIIPQFMCQGGDFTNHNGTGGKSIYGKKFDDENFILKHTGPGLLSMANSGPNTNGSQFFLTCDKTDWLDGKHVVFGEVTEGLDVLRQIEVAPDTKASKARGSRKNKDGQERNWGKSQKVESHTI

SEQ ID NO: 667 - protein, 1276 aa, Human
MRSKARARKLAKSDGDVVNNMYEPNRDLLASHSAEDEAEDSAMSPIPVGPPSPFPTSEDFTPKEGSPYEAPVYIPEDIPIPADFELRESSIPGAGLGVWAKRKMEAGERLGPCVVVPRAAAKETDFGWEQILTDVEVSPQEGCITKISEDLGSEKFCVDANQAGAGSWLKYIRVACSCDDQNLTMCQISEQIYYKVIKDIEPGEELLVHVKEGVYPLGTVPPGLDEEPTFRCDECDELFQSKLDLRRHKKYTCGSVGAALYEGLAEELKPEGLGGGSGQAHECKDCERMFPNKYSLEQHMVIHTEEREYKCDQCPKAFNWKSNLIRHQMSHDSGKRFECENCVKVFTDPSNLQRHIRSQHVGARAHACPDCGKTFATSSGLKQHKHIHSTVKPFICEVCHKSYTQFSNLCRHKRMHADCRTQIKCKDCGQMFSTTSSLNKHRRFCEGKNHYTPGGIFAPGLPLTPSPMMDKAKPSPSLNHASLGFNEYFPSRPHPGSLPFSTAPPTFPALTPGFPGIFPPSLYPRPPLLPPTSLLKSPLNHTQDAKLPSPLGNPALPLVSAVSNSSQGTTAAAGPEEKFESRLEDSCVEKLKTRSSDMSDGSDFEDVNTTTGTDLDTTTGTGSDLDSDVDSDPDKDKGKGKSAEGQPKFGGGLAPPGAPNSVAEVPVFYSQHSFFPPPDEQLLTATGAAGDSIKAIASIAEKYFGPGFMGMQEKKLGSLPYHSAFPFQFLPNFPHSLYPFTDRALAHNLLVKAEPKSPRDALKVGGPSAECPFDLTTKPKDVKPILPMPKGPSAPASGEEQPLDLSIGSRARASQNGGGREPRKNHVYGERKLGAGEGLPQVCPARMPQQPPLHYAKPSPFFMDPIYSRVEKRKVTDPVGALKEKYLRPSPLLFHPQMSAIETMTEKLESFAAMKADSGSSLQPLPHHPFNFRSPPPTLSDPILRKGKERYTCRYCGKIFPRSANLTRHLRTHTGEQPYRCKYCDRSFSISSNLQRHVRNIHNKEKPFKCHLCNRCFGQQTNLDRHLKKHEHENAPVSQHPGVLTNHLGTSASSPTSESDNHALLDEKEDSYFSEIRNFIANSEMNQASTRTEKRADMQIVDGSAQCPGLASEKQEDVEEEDDDDLEEDDEDSLAGKSQDDTVSPAPEPQAAYEDEEDEEPAASLAVGFDHTRRCAEDHEGGLLALEPMPTFGKGLDLRRAAEEAFEVKDVLNSTLDSEALKHTLCRQAKNQAYAMMLSLSEDTPLHTPSQGSLDAWLKVTGATSESGAFHPINHL

SEQ ID NO: 668 - protein, 915 aa, Human
MQGPDAPLLLSARELGPGRRGSASWYRQEGGAVCNWLRKPQPLEPRTSFPSARRSEFRPPRRLPWAGPASAQSEEGHAGGRCQAGSPAPARRLSGAFKTLVPGTHAQGASDTHPLGPPHTPVLDPSPQDGFPVLWRGSSKASHMNRLRNAKIYVERAVKQKKIFTIQGCYPVIRCLLRRRGWVEKKMVHRSGPTLLPPQKDLDSSAMGDSDTTEDEDEDEDEEFQPSQLFDFDDLLKFDDLDGTHALMVGLCLNLRNLPWFDEVDANSFFPRCYCLGAEDDKKAFIEDFWLTAARNVLKLVVKSEWKSYPIQAVEEEASGDKQPKKQEKNPVLVSPEFVDEALCACEEYLSNLAHMDIDKDLEAPLYLTPEGWSLFLQRYYQVVHEGAELRHLDTQVQRCEDILQQLQAVVPQIDMEGDRNIWIVKPGAKSRGRGIMCMDHLEEMLKLVNGNPVVMKDGKWVVQKYIERPLLIFGTKFDLRQWFLVTDWNPLTVWFYRDSYIRFSTQPFSLKNLDNSVHLCNNSIQKHLENSCHRHPLLPPDNMWSSQRFQAHLQEMGAPNAWSTIIVPGMKDAVIHALQTSQDTVQCRKASFELYGADFVFGEDFQPWLIEINASPTMAPSTAVTARLCAGVQADTLRVVIDRMLDRNCDTGAFELIYKQPAVEVPQYVGIRLLVEGFTIKKPMAMCHRRMGVRPAVPLLTQRGSGEARHHFPSLHTKAQLPSPHVLRHQGQVLRRQHSKLVGTKALSTTGKALRTLPTAKVFISLPPNLDFKVAPSILKPRKAPALLCLRGPQLEVPCCLCPLKSEQFLAPVGRSRPKANSRPDCDKPRAEACPMKRLSPLKPLPLVGTFQRRRGLGDMKLGKPLLRFPTALVLDPTPNKKKQVKYLGLDSIAVGGSRVDGARPCTPGSTARA

SEQ ID NO: 669 - protein, 485 aa, Human
MAPRLQLEKAAWRWAETVRPEEVSQEHIETAYRIWLEPCIRGVCRRNCKGNPNCLVGIGEHIWLGEIDENSFHNIDDPNCERRKKNSFVGLTNLGATCYVNTFLQVWFLNLELRQALYLCPSTCSDYMLGDGIQEEKDYEPQTICEHLQYLFALLQNSNRRYIDPSGFVKALGLDTGQQQDAQEFSKLFMSLLEDTLSKQKNPDVRNIVQQQFCGEYAYVTVCNQCGRESKLLSKFYELELNIQGHKQLTDCISEFLKEEKLEGDNRYFCENCQSKQNATRKIRLLSLPCTLNLQLMRFVFDRQTGHKKKLNTYIGFSEILDMEPYVEHKGGSYVYELSAVLIHRGVSAYSGHYIAHVKDPQSGEWYKFNDEDIEKMEGKKLQLGIEEDLAEPSKSQTRKPKCGKGTHCSRNAYMLVYRLQTQEKPNTTVQVPAFLQELVDRDNSKFEEWCIEMAEMRKQSVDKGKAKHEEVKELYQRLPAGAGL

SEQ ID NO: 670 - protein, 298 aa, Human
MVRMVPVLLSLLLLLGPAVPQENQDGRYSLTYIYTGLSKHVEDVPAFQALGSLNDLQFFRYNSKDRKSQPMGLWRQVEGMEDWKQDSQLQKAREDIFMETLKDIVEYYNDSNGSHVLQGRFGCEIENNRSSGAFWKYYYDGKDYIEFNKEIPAWVPFDPAAQITKQKWEAEPVYVQRAKAYLEEECPATLRKYLKYSKNILDRQDPPSVVVTSHQAPGEKKKLKCLAYDFYPGKIDVHWTRAGEVQEPELRGDVLHNGNGTYQSWVVVAVPPQDTAPYSCHVQHSSLAQPLVVPWEAS

SEQ ID NO: 671 - protein, 572 aa, Human
MAAPRPSPAISVSVSAPAFYAPQKKFGPVVAPKPKVNPFRPGDSEPPPAPGAQRAQMGRVGEIPPPPPEDFPLPPPPLAGDGDDAEGALGGAFPPPPPPIEESFPPAPLEEEIFPSPPPPPEEEGGPEAPIPPPPQPREKVSSIDLEIDSLSSLLDDMTKNDPFKARVSSGYVPPPVATPFSSKSSTKPAAGGTAPLPPWKSPSSSQPLPQVPAPAQSQTQFHVQPQPQPKPQVQLHVQSQTQPVSLANTQPRGPPASSPAPAPKFSPVTPKFTPVASKFSPGAPGGSGSQPNQKLGHPEALSAGTGSPQPPSFTYAQQREKPRVQEKQHPVPPPAQNQNQVRSPGAPGPLTLKEVEELEQLTQQLMQDMEHPQRQNVAVNELCGRCHQPLARAQPAVRALGQLFHIACFTCHQCAQQLQGQQFYSLEGAPYCEGCYTDTLEKCNTCGEPITDRMLRATGKAYHPHCFTCVVCARPLEGTSFIVDQANRPHCVPDYHKQYAPRCSVCSEPIMPEPGRDETVRVVALDKNFHMKCYKCEDCGKPLSIEADDNGCFPLDGHVLCRKCHTARAQT

SEQ ID NO: 672 - protein, 709 aa, Human
MATCAEILRSEFPEIDGQVFDYVTGVLHSGSADFESVDDLVEAVGELLQEVSGDSKDDAGIRAVCQRMYNTLRLAEPQSQGNSQVLLDAPIQLSKITENYDCGTKLPGLLKREQSSTVNAKKLEKAEARLKAKQEKRSEKDTLKTSNPLVLEEASASQAGSRKESRLESSGKNKSYDVRIENFDVSFGDRVLLAGADVNLAWGRRYGLVGRNGLGKTTLLKMLATRSLRVPAHISLLHVEQEVAGDDTPALQSVLESDSVREDLLRRERELTAQIAAGRAEGSEAAELAEIYAKLEEIEADKAPARASVILAGLGFTPKMQQQPTREFSGGWRMRLALARALFARPDLLLLDEPTNMLDVRAILWLENYLQTWPSTILVVSHDRNFLNAIATDIIHLHSQRLDGYRGDFETFIKSKQERLLNQQREYEAQQQYRQHIQVFIDRFRYNANRASQVQSKLKMLEKLPELKPVDKESEVVMKFPDGFEKFSPPILQLDEVDFYYDPKHVIFSRLSVSADLESRICVVGENGAGKSTMLKLLLGDLAPVRGIRHAHRNLKIGYFSQHHVEQLDLNVSAVELLARKFPGRPEEEYRHQLGRYGISGELAMRPLASLSGGQKSRVAFAQMTMPCPNFYILDEPTNHLDMETIEALGRALNNFRGGVILVSHDERFIRLVCRELWVCEGGGVTRVEGGFDQYRALLQEQFRREGFL

SEQ ID NO: 673 - protein, 397 aa, Human
MNAGSDPVVIVSAARTIIGSFNGALAAVPVQDLGSTVIKEVLKRATVAPEDVSEVIFGHVLAAGCGQNPVRQASVGAGIPYSVPAWSCQMICGSGLKAVCLAVQSIGIGDSSIVVAGGMENMSKAPHLAYLRTGVKIGEMPLTDSILCDGLTDAFHNCHMGITAENVAKKWQVSREDQDKVAVLSQNRTENAQKAGHFDKEIVPVLVSTRKGLIEVKTDEFPRHGSNIEAMSKLKPYFLTDGTGTVTPANASGINDGAAAVVLMKKSEADKRGLTPLARIVSWSQVGVEPSIMGIGPIPAIKQAVTKAGWSLEDVDIFEINEAFAAVSAAIVKELGLNPEKVNIEGGAIALGHPLGASGCRILVTLLHTLERMGRSRGVAALCIGGGMGIAMCVQRE

SEQ ID NO: 674 - protein, 215 aa, Human
MEKLYSENEGMASNQGKMENEEQPQDERKPEVTCTLEDKKLENEGKTENKGKTGDEEMLKDKGKPESEGEAKEGKSEREGESEMEGGSEREGKPEIEGKPESEGEPGSETRAAGKRPAEDDVPRKAKRKTNKGLAHYLKEYKEAIHDMNFSNEDMIREFDNMAKVQDEKRKSKQKLGAFLWMQRNLQDPFYPRGPREFRGGCRAPRRDIEDIPYV

SEQ ID NO: 675 - protein, 911 aa, Human
MVDYHAANQSYQYGPSSAGNGAGGGGSMGDYMAQEDDWDRDLLLDPAWEKQQRKTFTAWCNSHLRKAGTQIENIDEDFRDGLKLMLLLEVISGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEEIGRISIEMNGTLEDQLSHLKQYERSIVDYKPNLDLLEQQHQLIQEALIFDNKHTNYTMEHIRVGWEQLLTTIARTINEVENQILTRDAKGISQEQMQEFRASFNHFDKDHGGALGPEEFKACLISLGYDVENDRQGEAEFNRIMSLVDPNHSGLVTFQAFIDFMSRETTDTDTADQVIASFKVLAGDKNFITAEELRRELPPDQAEYCIARMAPYQGPDAVPGALDYKSFSTALYGESDL

SEQ ID NO: 676 - protein, 607 aa, Human
MAANVFPFRDARAAPDPVLEAGPVAHGPLPVPLVLDNGSFQVRAGWACPGQDPGPEPRLQFRAVCARGRGGARGASGPQVGNALGSLEPLRWMLRSPFDRNVPVNLELQELLLDYSFQHLGVSSQGCVDHPIVLTEAVCNPLYSRQMMSELLFECYGIPKVAYGIDSLFSFYHNKPKNSMCSGLIISSGYQCTHVLPILEGRLDAKNCKRINLGGSQAAGYLQRLLQLKYPGHLAAITLSRMEEILHEHSYIAEDYVEELHKWRCPDYYENNVHKMQLPFSSKLLGSTLTSEEKQERRQQQLRRLQELNARRREEKLQLDQERLDRLLYVQELLEDGQMDQFHKALIELNMDSPEELQSYIQKLSIAVEQAKQKILQAEVNLEVDVVDSKPETPDLEQLEPSLEDVESMNDFDPLFSEETPGVEKPVTTVQPVFNLAAYHQLFVGTERIRAPEIIFQPSLIGEEQAGIAETLQYILDRYPKDIQEMLVQNVFLTGGNTMYPGMKARMEKELLEMRPFRSSFQVQLASNPVLDAWYGARDWALNHLDDNEVWITRKEYEEKGGEYLKEHCASNIYVPIRLPKQASRSSDAQASSKGSAAGGGGAGEQA

SEQ ID NO: 677 - protein, 501 aa, Human
MSSSGTPDLPVLLTDLKIQYTKIFINNEWHDSVSGKKFPVFNPATEEELCQVEEGDKEDVDKAVKAARQAFQIGSPWRTMDASERGRLLYKLADLIERDRLLLATMESMNGGKLYSNAYLNDLAGCIKTLRYCAGWADKIQGRTIPIDGNFFTYTRHEPIGVCGQIIPWNFPLVMLIWKIGPALSCGNTVVVKPAEQTPLTALHVASLIKEAGFPPGVVNIVPGYGPTAGAAISSHMDIDKVAFTGSTEVGKLIKEAAGKSNLKRVTLELGGKSPCIVLADADLDNAVEFAHHGVFYHQGQCCIAASRIFVEESIYDEFVRRSVERAKKYILGNPLTPGVTQGPQIDKEQYDKILDLIESGKKEGAKLECGGGPWGNKGYFVQPTVFSNVTDEMRIAKEEIFGPVQQIMKFKSLDDVIKRANNTFYGLSAGVFTKDIDKAITISSALQAGTVWVNCYGVVSAQCPFGGFKMSGNGRELGEYGFHEYTEVKTVTVKISQKNS

SEQ ID NO: 678 - protein, 1244 aa, Human
MNNQKVVAVLLQECKQVLDQLLLEAPDVSEEDKSEDQRCRALLPSELRTLIQEAKEMKWPFVPEKWQYKQAVGPEDKTNLKDVIGAGLQQLLASLRASILARDCAAAAAIVFLVDRFLYGLDVSGKLLQVAKGLHKLQPATPIAPQVVIRQARISVNSGKLLKAEYILSSLISNNGATGTWLYRNESDKVLVQSVCIQIRGQILQKLGMWYEAAELIWASIVGYLALPQPDKKGLSTSLGILADIFVSMSKNDYEKFKNNPQINLSLLKEFDHHLLSAAEACKLAAAFSAYTPLFVLTAVNIRGTCLLSYSSSNDCPPELKNLHLCEAKEAFEIGLLTKRDDEPVTGKQELHSFVKAAFGLTTVHRRLHGETGTVHAASQLCKEAMGKLYNFSTSSRSQDREALSQEVMSVIAQVKEHLQVQSFSNVDDRSYVPESFECRLDKLILHGQGDFQKILDTYSQHHTSVCEVFESDCGNNKNEQKDAKTGVCITALKTEIKNIDTVSTTQEKPHCQRDTGISSSLMGKNVQRELRRGGRRNWTHSDAFRVSLDQDVETETEPSDYSNGEGAVFNKSLSGSQTSSAWSNLSGFSSSASWEEVNYHVDDRSARKEPGKEHLVDTQCSTALSEELENDREGRAMHSLHSQLHDLSLQEPNNDNLEPSQNQPQQQMPLTPFSPHNTPGIFLAPGAGLLEGAPEGIQEVRNMGPRNTSAHSRPSYRSASWSSDSGRPKNMGTHPSVQKEEAFEIIVEFPETNCDVKDRQGKEQGEEISERGAGPTFKASPSWVDPEGETAESTEDAPLDFHRVLHNSLGNISMLPCSSFTPNWPVQNPDSRKSGGPVAEQGIDPDASTVDEEGQLLDSMDVPCTNGHGSHRLCILRQPPGQRAETPNSSVSGNILFPVLSEDCTTTEEGNQPGNMLNCSQNSSSSSVWWLKSPAFSSGSSEGDSPWSYLNSSGSSWVSLPGKMRKEILEARTLQPDDFEKLLAGVRHDWLFQRLENTGVFKPSQLHRAHSALLLKYSKKSELWTAQETIVYLGDYLTVKKKGRQRNAFWVHHLHQEEILGRYVGKDYKEQKGLWHHFTDVERQMTAQHYVTEFNKRLYEQNIPTQIFYIPSTILLILEDKTIKGCISVEPYILGEFVKLSNNTKVVKTEYKATEYGLAYGHFSYEFSNHRDVVVDLQGWVTGNGKGLIYLTDPQIHSVDQKVFTTNFGKRGIFYFFNNQHVECNEICHRLSLTRPSMEKPCT

SEQ ID NO: 679 - protein, 737 aa, Human
MAHRKLESVGSGMLDHRVRPGPVPHSQEPESEDMELPLEGYVPEGLELAALRPESPAPEEQECHNHSPDGDSSSDYVNNTSEEEDYDEGLPEEEEGITYYIRYCPEDDSYLEGMDCNGEEYLAHSAHPVDTDECQEAVEEWTDSAGPHPHGHEAEGSQDYPDGQLPIPEDEPSVLEAHDQEEDGHYCASKEGYQDYYPEEANGNTGASPYRLRRGDGDLEDQEEDIDQIVAEIKMSLSMTSITSASEASPEHGPEPGPEDSVEACPPIKASCSPSRHEARPKSLNLLPEAKHPGDPQRGFKPKTRTPEERLKWPHEQVCNGLEQPRKQQRSDLNGPVDNNNIPETKKVASFPSFVAVPGPCEPEDLIDGIIFAANYLGSTQLLSERNPSKNIRMMQAQEAVSRVKNSEGDAQTLTEVDLFISTQRIKVLNADTQETMMDHALRTISYIADIGNIVVLMARRRMPRSASQDCIETTPGAQEGKKQYKMICHVFESEDAQLIAQSIGQAFSVAYQEFLRANGINPEDLSQKEYSDIINTQEMYNDDLIHFSNSENCKELQLEKHKGEILGVVVVESGWGSILPTVILANMMNGGPAARSGKLSIGDQIMSINGTSLVGLPLATCQGIIKGLKNQTQVKLNIVSCPPVTTVLIKRPDLKYQLGFSVQNGIICSLMRGGIAERGGVRVGHRIIEINGQSVVATAHEKIVQALSNSVGEIHMKTMPAAMFRLLTGQETPLYI

SEQ ID NO: 680 - protein, 709 aa, Human
MAQRHSDSSLEEKLLGHRFHSELRLDAGGNPASGLPMVRGSPRVRDDAAFQPQVPAPPQPRPPGHEEPWPIVLSTESPAALKLGTQQLIPKSLAVASKAKTPARHQSFGAAVLSREAARRDPKLLPAPSFSLDDMDVDKDPGGMLRRNLRNQSYRAAMKGLGKPGGQGDAIQLSPKLQALAEEPSQPHTRSPAKNKKTLGRKRGHKGSFKDDPQLYQEIQERGLNTSQESDDDILDESSSPEGTQKVDATIVVKSYRPAQVTWSQLPEVVELGILDQLSTEERKRQEAMFEILTSEFSYQHSLSILVEEFLQSKELRATVTQMEHHHLFSNILDVLGASQRFFEDLEQRHKAQVLVEDISDILEEHAEKHFHPYIAYCSNEVYQQRTLQKLISSNAAFREALREIERRPACGGLPMLSFLILPMQRVTRLPLLMDTLCLKTQGHSERYKAASRALKAISKLVRQCNEGAHRMERMEQMYTLHTQLDFSKVKSLPLISASRWLLKRGELFLVEETGLFRKIASRPTCYLFLFNDVLVVTKKKSEESYMVQDYAQMNHIQVEKIEPSELPLPGGGNRSSSVPHPFQVTLLRNSEGRQEQLLLSSDSASDRARWIVALTHSERQWQGLSSKGDLPQVEITKAFFAKQADEVTLQQADVVLVLQQEDGWLYGERLRDGETGWFPEDFARFITSRVAVEGNVRRMERLRVETDV

SEQ ID NO: 681 - protein, 563 aa, Human
METAKQKALEVANRLYQKDLRAPDVVIGADTIVTVGGLILEKPVDKQDAYRMLSRLSGREHSVFTGVAIVHCSSKDHQLDTRVSEFYEETKVKFSELSEELLWEYVHSGEPMDKAGGYGIQALGGMLVESVHGDFLNVVGFPLNHFCKQLVKLYYPPRPEDLRRSVKHDSIPAADTFEDLSDVEGGGSEPTQRDAGSRDEKAEAGEAGQATAEAECHRTRETLPPFPTRLLELIEGFMLSKGLLTACKLKVFDLLKDEAPQKAADIASKVDASACGMERLLDICAAMGLLEKTEQGYSNTETANVYLASDGEYSLHGFIMHNNDLTWNLFTYLEFAIREGTNQHHRALGKKAEDLFQDAYYQSPETRLRFMRAMHGMTKLTACQVATAFNLSRFSSACDVGGCTGALARELAREYPRMQVTVFDLPDIIELAAHFQPPGPQAVQIHFAAGDFFRDPLPSAELYVLCRILHDWPDDKVHKLLSRVAESCKPGAGLLLVETLLDEEKRVAQRALMQSLNMLVQTEGKERSLGEYQCLLELHGFHQVQVVHLGGVLDAILATKVAP

SEQ ID NO: 682 - protein, 1175 aa, Human
MSADSSPLVGSTPTGYGTLTIGTSIDPLSSSVSSVRLSGYCGSPWRVIGYHVVVWMMAGIPLLLFRWKPLWGVRLRLRPCNLAHAETLVIEIRDKEDSSWQLFTVQVQTEAIGEGSLEPSPQSQAEDGRSQAAVGAVPEGAWKDTAQLHKSEEAKRVLRYYLFQGQRYIWIETQQAFYQVSLLDHGRSCDDVHRSRHGLSLQDQMVRKAIYGPNVISIPVKSYPQLLVDEALNPYYGFQAFSIALWLADHYYWYALCIFLISSISICLSLYKTRKQSQTLRDMVKLSMRVCVCRPGGEEEWVDSSELVPGDCLVLPQEGGLMPCDAALVAGECMVNESSLTGESIPVLKTALPEGLGPYCAETHRRHTLFCGTLILQARAYVGPHVLAVVTRTGFCTAKGGLVSSILHPRPINFKFYKHSMKFVAALSVLALLGTIYSIFILYRNRVPLNEIVIRALDLVTVVVPPALPAAMTVCTLYAQSRLRRQGIFCIHPLRINLGGKLQLVCFDKTGTLTEDGLDVMGVVPLKGQAFLPLVPEPRRLPVGPLLRALATCHALSRLQDTPVGDPMDLKMVESTGWVLEEEPAADSAFGTQVLAVMRPPLWEPQLQAMEEPPVPVSVLHRFPFSSALQRMSVVVAWPGATQPEAYVKGSPELVAGLCNPETVPTDFAQMLQSYTAAGYRVVALASKPLPTVPSLEAAQQLTRDTVEGDLSLLGLLVMRNLLKPQTTPVIQALRRTRIRAVMVTGDNLQTAVTVARGCGMVAPQEHLIIVHATHPERGQPASLEFLPMESPTAVNGVKDPDQAASYTVEPDPRSRHLALSGPTFGIIVKHFPKLLPKVLVQGTVFARMAPEQKTELVCELQKLQYCVGMCGDGANDCGALKAADVGISLSQAEASVVSPFTSSMASIECVPMVIREGRCSLDTSFSVFKYMALYSLTQFISVLILYTINTNLGDLQFLAIDLVITTTVAVLMSRTGPALVLGRVRPPGALLSVPVLSSLLLQMVLVTGVQLGGYFLTLAQPWFVPLNRTVAAPDNLPNYENTVVFSLSSFQYLILAAAVSKGAPFRRPLYTNVPFLVALALLSSVLVGLVLVPGLLQGPLALRNITDTGFKLLLLGLVTLNFVGAFMLESVLDQCLPACLRRLRPKRASKKRFKQLERELAEQPWPPLPAGPLR

SEQ ID NO: 683 - protein, 1322 aa, Human
MPVVWPTLLDLSRDECKRILRKLELEAYAGVISALRAQGDLTKEKKDLLGELSKVLSISTERHRAEVRRAVNDERLTTIAHNMSGPNSSSEWSIEGRRLVPLMPRLVPQTAFTVTANAVANAAIQHNASLPVPAETGSKEVVCYSYTSTTSTPTSTPVPSGSIATVKSPRPASPASNVVVLPSGSTVYVKSVSCSDEDEKPRKRRRTNSSSSSPVVLKEVPKAVVPVSKTITVPVSGSPKMSNIMQSIANSLPPHMSPVKITFTKPSTQTTNTTTQKVIIVTTSPSSTFVPNILSKSHNYAAVTKLVPTSVIASTTQKPPVVITASQSSLVSNSSSGSSSSTPSPIPNTVAVTAVVSSTPSVVMSTVAQGVSTSAIKMASTRLPSPKSLVSAPTQILAQFPKQHQQSPKQQLYQVQQQTQQQVAQPSPVSHQQQPQQSPLPPGIKPTIQIKQESGVKIITQQVQPSKILPKPVTATLPTSSNSPIMVVSSNGAIMTTKLVTTPTGTQATYTRPTVSPSIGRMAATPGAATYVKTTSGSIITVVPKSLATLGGKIISSNIVSGTTTKITTIPMTSKPNVIVVQKTTGKGTTIQGLPGKNVVTTLLNAGGEKTIQTVPTGAKPAILTATRPITKMIVTQPKGIGSTVQPAAKIIPTKIVYGQQGKTQVLIKPKPVTFQATVVSEQTRQLVTETLQQASRVAEAGNSSIQEGKEEPQNYTDSSSSSTESSQSSQDSQPVVHVIASRRQDWSEHEIAMETSPTIIYQDVSSESQSATSTIKALLELQQTTVKEKLESKPRQPTIDLSQMAVPIQMTQEKRHSPESPSIAVVESELVAEYITTERTDEGTEVAFPLLVSHRSQPQQPSQPQRTLLQHVAQSQTATQTSVVVKSIPASSPGAITHIMQQALSSHTAFTKHSEELGTEEGEVEEMDTLDPQTGLFYRSALTQSQSAKQQKLSQPPLEQTQLQVKTLQCFQTKQKQTIHLQADQLQHKLPQMPQLSIRHQKLTPLQQEQAQPKPDVQHTQHPMVAKDRQLPTLMAQPPQTVVQVLAVKTTQQLPKLQQAPNQPKIYVQPQTPQSQMSLPASSEKQTASQVEQPIITQGSSVTKITFEGRQPPTVTKITGGSSVPKLTSPVTSISPIQASEKTAVSDILKMSLMEAQIDTNVEHMIVDPPKKALATSMLTGEAGSLPSTHMVVAGMANSTPQQQKCRESCSSPSTVGSSLTTRKIDPPAVPATGQFMRIQNVGQKKAEESPAEIIIQAIPQYAIPCHSSSNVVVEPSGLLELNNFTSQQLDDEETAMEQDIDSSTEDGTEPSPSQSSAERS

SEQ ID NO: 684 - protein, 304 aa, Human
MADNSSDECEEENNKEKKKTSQLTPQRGFSENEDDDDDDDDSSETDSDSDDDDEEHGAPLEGAYDPADYEHLPVSAEIKELFQYISRYTPQLIDLDHKLKPFIPDFIPAVGDIDAFLKVPRPDGKPDNLGLLVLDEPSTKQSDPTVLSLWLTENSKQHNITQHMKVKSLEDAEKNPKAIDTWIESISELHRSKPPATVHYTRPMPDIDTLMQEWSPEFEELLGKVSLPTAEIDCSLAEYIDMICAILDIPVYKSRIQSLHLLFSLYSEFKNSQHFKALAEGKKAFTPSSNSTSQAGDMETLTFS

SEQ ID NO: 685 - protein, 342 aa, Human
MDDKPNPEALSDSSERLFSFGVIADVQFADLEDGFNFQGTRRRYYRHSLLHLQGAIEDWNNESSMPCCVLQLGDIIDGYNAQYNASKKSLELVMDMFKRLKVPVHHTWGNHEFYNFSREYLTHSKLNTKFLEDQIVHHPETMPSEDYYAYHFVPFPKFRFILLDAYDLSVLGVDQSSPKYEQCMKILREHNPNTELNSPQGLSEPQFVQFNGGFSQEQLNWLNEVLTFSDTNQEKVVIVSHLPIYPDASDNVCLAWNYRDALAVIWSHECVVCFFAGHTHDGGYSEDPFGVYHVNLEGVIETAPDSQAFGTVHVYPDKMMLKGRGRVPDRIMNYKKERAFHC

SEQ ID NO: 686 - protein, 260 aa, Human
MAAAALRRFWSRRRAEAGDAVVAKPGVWARLGSWARALLRDYAEACRDASAEARARPGRAAVYVGLLGGAAACFTLAPSEGAFEEALLEASGTLLLLAPATRNRESEAFVQRLLWLRGRGRLRYVNLGLCSLVYEAPFDAQASLYQARCRYLQPRWTDFPGRVLDVGFVGRWWVLGAWMRDCDINDDEFLHLPAHLRVVGPQQLHSETNERLFDEKYKPVVLTDDQVDQALWEEQVLQKEKKDRLALSQAHSLVQAEAPR

SEQ ID NO: 687 - protein, 306 aa, Human
MGCDGGTIPKRHELVKGPKKVEKVDKDAELVAQWNYCTLSQEILRRPIVACELGRLYNKDAVIEFLLDKSAEKALGKAASHIKSIKNVTELKLSDNPAWEGDKGNTKGDKHDDLQRARFICPVVGLEMNGRHRFCFLRCCGCVFSERALKEIKAEVCHTCGAAFQEDDVIMLNGTKEDVDVLKTRMEERRLRAKLEKKTKKPKAAESVSKPDVSEEAPGPSKVKTGKPEEASLDSREKKTNLAPKSTAMNESSSGKAGKPPCGATKRSIADSEESEAYKSLFTTHSSAKRSKEESAHWVTHTSYCF

SEQ ID NO: 688 - protein, 1814 aa, Human
MMDLVLEEDVTVPGTLSGCSGLVPSVPDDLDGINPNAGLGNGLLPNVSEETVSPTRARNMKDFENQITELKKENFNLKLRIYFLEERMQQEFHGPTEHIYKTNIELKVEVESLKRELQEREQLLIKASKAVESLAEAGGSEIQRVKEDARKKVQQVEDLLTKRILLLEKDVTAAQAELEKAFAGTETEKALRLRLESKLSEMKKMHEGDLAMALVLDEKDRLIEELKLSLKSKEALIQCLKEEKSQMACPDENVSSGELRGLCAAPREEKERETEAAQMEHQKERNSFEERIQALEEDLREKEREIATEKKNSLKRDKAIQGLTMALKSKEKKVEELNSEIEKLSAAFAKAREALQKAQTQEFQGSEDYETALSGKEALSAALRSQNLTKSTENHRLRRSIKKITQELSDLQQERERLEKDLEEAHREKSKGDCTIRDLRNEVEKLRNEVNEREKAMENRYKSLLSESNKKLHNQEQVIKHLTESTNQKDVLLQKFNEKDLEVIQQNCYLMAAEDLELRSEGLITEKCSSQQPPGSKTIFSKEKKQSSDYEELIQVLKKEQDIYTHLVKSLQESDSINNLQAELNKIFALRKQLEQDVLSYQNLRKTLEEQISEIRRREEESFSLYSDQTSYLSICLEENNRFQVEHFSQEELKKKVSDLIQLVKELYTDNQHLKKTIFDLSCMGFQGNGFPDRLASTEQTELLASKEDEDTIKIGEDDEINFLSDQHLQQSNEIMKDLSKGGCKNGYLRHTESKISDCDGAHAPGCLEEGAFINLLAPLFNEKATLLLESRPDLLKVVRELLLGQLFLTEQEVSGEHLDGKTEKTPKQKGELVHFVQTNSFSKPHDELKLSCEAQLVKAGEVPKVGLKDASVQTVATEGDLLRFKHEATREAWEEKPINTALSAEHRPENLHGVPGWQAALLSLPGITNREAKKSRLPILIKPSRSLGNMYRLPATQEVVTQLQSQILELQGELKEFKTCNKQLHQKLILAEAVMEGRPTPDKTLLNAQPPVGAAYQDSPGEQKGIKTTSSVWRDKEMDSDQQRSYEIDSEICPPDDLASLPSCKENPEDVLSPTSVATYLSSKSQPSAKVSVMGTDQSESINTSNETEYLKQKIHDLETELEGYQNFIFQLQKHSQCSEAIITVLCGTEGAQDGLSKPKNGSDGEEMTFSSLHQVRYVKHVKILGPLAPEMIDSRVLENLKQQLEEQEYKLQKEQNLNMQLFSEIHNLQNKFRDLSPPRYDSLVQSQARELSLQRQQIKDGHGICVISRQHMNTMIKAFEELLQASDVDYCVAEGFQEQLNQCAELLEKLEKLFLNGKSVGVEMNTQNELMERIEEDNLTYQHLLPESPEPSASHALSDYETSEKSFFSRDQKQDNETEKTSVMVNSFSQDLLMEHIQEIRTLRKRLEESIKTNEKLRKQLERQGSEFVQGSTSIFASGSELHSSLTSEIHFLRKQNQALNAMLIKGSRDKQKENDKLRESLSRKTVSLEHLQREYASVKEENERLQKEGSEKERHNQQLIQEVRCSGQELSRVQEEVKLRQQLLSQNDKLLQSLRVELKAYEKLDEEHRRLRDGDKYPMESDNSFDLFDSSQAVTPKSVSETPPLSGNDTDSLSCDSGSSATSTPCVSRLVTGHHLWASKNGRHVLGLIEDYEALLKQISQGQRLLAEMDIQTQEAPSSTSQELGTKGPHPAPLSKFVSSVSTAKLTLEEAYRRLKLLWRVSLPEDGQCPLHCEQIGEMKAEVTKLHKKLFEQEKKLQNTMKLLQLSKRQEKVIFDQLVVTHKILRKARGNLELRPGGAHPGTCSPSRPGS

SEQ ID NO: 689 - protein, 179 aa, Human
MLSRCRSGLLHVLGLSFLLQTRRPILLCSPRLMKPLVVFVLGGPGAGKGTQCARIVEEMDQTMAANAQKNKFLIDGFPRNQDNLQGWNKTMDGKADVSFVLFFDCNNEICIERCLERGKSSGRSDDNRESLEKRIQTYLQSTKPIIDLYEEMGKVKKIDASKSVDEVFDEVVQIFDKEG

SEQ ID NO: 690 - protein, 475 aa, Human
MSWRPQYRSSKFRNVYGKVANREHCFDGIPITKNVHDNHFCAVNTRFLAIVTESAGGGSFLVIPLEQTGRIEPNYPKVCGHQGNVLDIKWNPFIDNIIASCSEDTSVRIWEIPEGGLKRNMTEALLELHGHSRRVGLVEWHPTTNNILFSAGYDYKVLIWNLDVGEPVKMIDCHTDVILCMSFNTDGSLLTTTCKDKKLRVIEPRSGRVLQEANCKNHRVNRVVFLGNMKRLLTTGVSRWNTRQIALWDQEDLSMPLIEEEIDGLSGLLFPFYDADTHMLYLAGKGDGNIRYYEISTEKPYLSYLMEFRSPAPQKGLGVMPKHGLDVSACEVFRFYKLVTLKGLIEPISMIVPRRSDSYQEDIYPMTPGTEPALTPDEWLGGINRDPVLMSLKEGYKKSSKMVFKAPIKEKKSVVVNGIDLLENVPPRTENELLRMFFRQQDEIRRLKEELAQKDIRIRQLQLELKNLRNSPKNC

SEQ ID NO: 691 - protein, 150 aa, Human
MLGAALRRCAVAATTRADPRGLLHSARTPGPAVAIQSVRCYSHGSQETDEEFDARWVTYFNKPDIDAWELRKGINTLVTYDMVPEPKIIDAALRACRRLNDFASTVRILEVVKDKAGPHKEIYPYVIQELRPTLNELGISTPEELGLDKV

SEQ ID NO: 692 - protein, 445 aa, Human
MALVDKHKVKRQRLDRICEGIRPQIMNGPLHPRPLVALLDGRDCTVEMPILKDLATVAFCDAQSTQEIHEKVLNEAVGAMMYHTITLTREDLEKFKALRVIVRIGSGYDNVDIKAAGELGIAVCNIPSAAVEETADSTICHILNLYRRNTWLYQALREGTRVQSVEQIREVASGAARIRGETLGLIGFGRTGQAVAVRAKAFGFSVIFYDPYLQDGIERSLGVQRVYTLQDLLYQSDCVSLHCNLNEHNHHLINDFTIKQMRQGAFLVNAARGGLVDEKALAQALKEGRIRGAALDVHESEPFSFAQGPLKDAPNLICTPHTAWYSEQASLEMREAAATEIRRAITGRIPESLRNCVNKEFFVTSAPWSVIDQQAIHPELNGATYRYPPGIVGVAPGGLPAAMEGIIPGGIPVTHNLPTVAHPSQAPSPNQPTKHGDNREHPNEQ

SEQ ID NO: 693 - protein, 520 aa, Human
MSQLSLSWLGLWPVAASPWLLLLLVGASWLLAHVLAWTYAFYDNCRRLRCFPQPPRRNWFWGHQGMVNPTEEGMRVLTQLVATYPQGFKVWMGPISPLLSLCHPDIIRSVINASAAIAPKDKFFYSFLEPWLGDGLLLSAGDKWSRHRRMLTPAFHFNILKPYMKIFNESVNIMHAKWQLLASEGSACLDMFEHISLMTLDSLQKCVFSFDSHCQEKPSEYIAAILELSALVSKRHHEILLHIDFLYYLTPDGQRFRRACRLVHDFTDAVIQERRRTLPSQGVDDFLQAKAKSKTLDFIDVLLLSKDEDGKKLSDEDIRAEADTFMFEGHDTTASGLSWVLYHLAKHPEYQERCRQEVQELLKDREPKEIEWDDLAHLPFLTMCMKESLRLHPPVPVISRHVTQDIVLPDGRVIPKGIICLISVFGTHHNPAVWPDPEVYDPFRFDPENIKERSPLAFIPFSAGPRNCIGQTFAMAEMKVVLALTLLRFRVLPDHTEPRRKPELVLRAEGGLWLRVEPLS

SEQ ID NO: 694 - protein, 1496 aa, Human
MAEERPPRLVDYFVVAGLAGNGAPIPEETWVPEPSGPLRPPRPAEPITDVAVIARALGEEVPQGYTCIQASAGGHPLELSAGLLGGTQPVICYRRGRDKPPLVELGVLYEGKERPKPGFQVLDTTPYSHSANLAPPGPGHPRTYLTYRRAAEGAGLHALGITDLCLVLPSKGEGTPHTYCRLPRNLNPGMWGPAVYLCYKVGLAKANTLVYEAELLGRYPEEDNEAFPLPESVPVFCLPMGATIECWPAQTKYPVPVFSTFVLTGAAGDKVYGAALQFYEAFPRARLSERQARALGLLSAVERGRALGGRAVRSRRAIAVLSRWPAFPAFRAFLTFLYRYSVSGPHRLPLEAHISHFIHNVPFPSPQRPRILVQMSPYDNLLLCQPVSSPLPLSGASFLQLLQSLGPELAITLLLAVLTEHKLLVHSLRPDLLTSVCEALVSMIFPLHWQCPYIPLCPLVLADVLSAPVPFIVGIHSSYFDLHDPPADVICVDLDTNTLFQTEEKKLLSPRTLPRRPYKVLLATLTNLYQQLDQTYTGPEEEASLEFLLTDYEAVCGRRARLEREVQGAFLRFMACLLKGYRVFLRPLTQAPSEGARDVDNLFFLQGFLKSRERSSHKLYSQLLHTQMFSQFIEECSFGSARHAALEFFDSCVEKVHPEQEKPEPTPLVELEELSGSELTVFITPPEEPALPEGSESTPQYCYDGFPELRAELFESLQEQPGALPVPGPSRSAPSSPAPRRTKQEMKVAQRMAQKSAAVPELWARCLLGHCYGLWFLCLPAYVRSAPSRVQALHTAYHVLRQMESGKVVLPDEVCYRVLMQLCSHYGQPVLSVRVMLEMRQAGIVPNTITYGYYNKAVLESKWPSGTPGGRLRWAKLRNVVLGAAQFRQPLRERQQQQQQQQQQQQQQQQEQVSAHQEAGSSQAEPYLERPSPTRPLQRQTTWAGRSLRDPASPPGRLVKSGSLGSARGAQPTVEAGVAHMIEALGVLEPRGSPVPWHDGSLSDLSLTGEEPLPGGSPGGSGSALSAQSTEALEGLSGRGPKAGGRQDEAGTPRRGLGARLQQLLTPSRHSPASRIPPPELPPDLPPPARRSPMDSLLHPRERPGSTASESSASLGSEWDLSESSLSNLSLRRSSERLSDTPGSFQSPSLEILLSSCSLCRACDSLVYDEEIMAGWAPDDSNLNTTCPFCACPFVPLLSVQTLDSRPSVPSPKSAGASGSKDAPVPGGPGPVLSDRRLCLALDEPQLCNGHMGGASRRVESGAWAYLSPLVLRKELESLVENEGSEVLALPELPSAHPIIFWNLLWYFQRLRLPSILPGLVLASCDGPSHSQAPSPWLTPDPASVQVRLLWDVLTPDPNSCPPLYVLWRVHSQIPQRVVWPGPVPASLSLALLESVLRHVGLNEVHKAVGLLLETLGPPPTGLHLQRGIYREILFLTMAALGKDHVDIVAFDKKYKSAFNKLASSMGKEELRHRRAQMPTPKAIDCRKCFGAPPEC

SEQ ID NO: 695 - protein, 278 aa, Human
MHKAGLLGLCARAWNSVRMASSGMTRRDPLANKVALVTASTDGIGFAIARRLAQDGAHVVVSSRKQQNVDQAVATLQGEGLSVTGTVCHVGKAEDRERLVATAVKLHGGIDILVSNAAVNPFFGSIMDVTEEVWDKTLDINVKAPALMTKAVVPEMEKRGGGSVVIVSSIAAFSPSPGFSPYNVSKTALLGLTKTLAIELAPRNIRVNCLAPGLIKTSFSRMLWMDKEKEESMKETLRIRRLGEPEDCAGIVSFLCSEDASYITGETVVVGGGTPSRL

SEQ ID NO: 696 - protein, 351 aa, Human
MLETLRERLLSVQQDFTSGLKTLSDKSREAKVKSKPRTVPFLPKYSAGLELLSRYEDTWAALHRRAKDCASAGELVDSEVVMLSAHWEKKKTSLVELQEQLQQLPALIADLESMTANLTHLEASFEEVENNLLHLEDLCGQCELERCKHMQSQQLENYKKNKRKELETFKAELDAEHAQKVLEMEHTQQMKLKERQKFFEEAFQQDMEQYLSTGYLQIAERREPIGSMSSMEVNVDMLEQMDLMDISDQEALDVFLNSGGEENTVLSPALGPESSTCQNEITLQVPNPSELRAKPPSSSSTCTDSATRDISEGGESPVVQSDEEEVQVDTALATSHTDREATPDGGEDSDS

SEQ ID NO: 697 - protein, 647 aa, Human
MRSGKASCTLETVWEDKHKYEEAERRFYEHEATQAAASAQQLPAEGPAMNGPGQDDPEDADEAEAPDGGSRRDPRKSQDSRKPLQKKRKRSPKSGLGPADLALLGLSAERVWLDKSLFDQAESSYRQKLADVAAQAAWPPALAPWGLCTHGNQVACHHVTWGIWVNKSSFDQAERAFVEWSQALLLAPEGSRRQGTPNTGQQVAVPDLAHQPSPPVNGQPPLGSLQALVREVWLEKPRYDAAERGFYEALFDGHPPGKVRLQERAGLAEGARRGRRDRRGRNILGNKRAGLRRADGEAPSALPYCYFLQKDAEAPWLSKPAYDSAECRHHAAEALRVAWCLEAASLSHRPGPRSGLSVSSLRPNRKMATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDNEEEDKEAAQLREERLRQYAEKKAKKPALVAKSSILLDVKPWDDETDMAQLEACVRSIQLDGLVWGASKLVPVGYGIRKLQIQCVVEDDKVGTDLLEEEITKFEEHVQSVDIAAFNKI

SEQ ID NO: 698 - protein, 412 aa, Human
MEFQAVVMAVGGGSRMTDLTSSIPKPLLPVGNKPLIWYPLNLLERVGFEEVIVVTTRDVQKALCAEFKMKMKPDIVCIPDDADMGTADSLRYIYPKLKTDVLVLSCDLITDVALHEVVDLFRAYDASLAMLMRKGQDSIEPVPGQKGKKKAVEQRDFIGVDSTGKRLLFMANEADLDEELVIKGSILQKHPRIRFHTGLVDAHLYCLKKYIVDFLMENGSITSIRSELIPYLVRKQFSSASSQQGQEEKEEDLKKKELKSLDIYSFIKEANTLNLAPYDACWNACRGDRWEDLSRSQVRCYVHIMKEGLCSRVSTLGLYMEANRQVPKLLSALCPEEPPVHSSAQIVSKHLVGVDSLIGPETQIGEKSSIKRSVIGSSCLIKDRVTITNCLLMNSVTVEEGYVSPCTHLRQR

SEQ ID NO: 699 - protein, 715 aa, Human
MSQSGAVSCCPGATNGSLGRSDGVAKMSPKDLFEQRKKYSNSNVIMHETSQYHVQHLATFIMDKSEAITSVDDAIRKLVQLSSKEKIWTQEMLLQVNDQSLRLLDIESQEELEDFPLPTVQRSQTVLNQLRYPSVLLLVCQDSEQSKPDVHFFHCDEVEAELVHEDIESALADCRLGKKMRPQTLKGHQEKIRQRQSILPPPQGPAPIPFQHRGGDSPEAKNRVGPQVPLSEPGFRRRESQEEPRAVLAQKIEKETQILNCALDDIEWFVARLQKAAEAFKQLNQRKKGKKKGKKAPAEGVLTLRARPPSEGEFIDCFQKIKLAINLLAKLQKHIQNPSAAELVHFLFGPLDLIVNTCSGPDIARSVSCPLLSRDAVDFLRGHLVPKEMSLWESLGESWMRPRSEWPREPQVPLYVPKFHSGWEPPVDVLQEAPWEVEGLASAPIEEVSPVSRQSIRNSQKHSPTSEPTPPGDALPPVSSPHTHRGYQPTPAMAKYVKILYDFTARNANELSVLKDEVLEVLEDGRQWWKLRSRSGQAGYVPCNILGEARPEDAGAPFEQAGQKYWGPASPTHKLPPSFPGNKDELMQHMDEVNDELIRKISNIRAQPQRHFRVERSQPVSQPLTYESGPDEVRAWLEAKAFSPRIVENLGILTGPQLFSLNKEELKKVCGEEGVRVYSQLTMQKAFLEKQQSGSELEELMNKFHSMNQRRGEDS

SEQ ID NO: 700 - protein, 392 aa, Human
MEAPLVSLDEEFEDLRPSCSEDPEEKPQCFYGSSPHHLEDPSLSELENFSSEIISFKSMEDLVNEFDEKLNVCFRNYNAKTENLAPVKNQLQIQEEEETLQDEEVWDALTDNYIPSLSEDWRDPNIEALNGNCSDTEIHEKEEEEFNEKSENDSGINEEPLLTADQVIEEIEEMMQNSPDPEEEEEVLEEEDGGETSSQADSVLLQEMQALTQTFNNNWSYEGLRHMSGSELTELLDQVEGAIRDFSEELVQQLARRDELEFEKEVKNSFITVLIEVQNKQKEQRELMKKRRKEKGLSLQSSRIEKGNQMPLKRFSMEGISNILQSGIRQTFGSSGTDKQYLNTVIPYEKKASPPSVEDLQMLTNILFAMKEDNEKVPTLLTDYILKVLCPT

SEQ ID NO: 701 - protein, 345 aa, Human
MSHLFDPRLPALAASPMLYLYGPERPGLPLAFAPAAALAASGRAETPQKPPYSYIALIAMAIQDAPEQRVTLNGIYQFIMDRFPFYHDNRQGWQNSIRHNLSLNDCFVKVPREKGRPGKGSYWTLDPRCLDMFENGNYRRRKRKPKPGPGAPEAKRPRAETHQRSAEAQPEAGSGAGGSGPAISRLQAAPAGPSPLLDGPSPPAPLHWPGTASPNEDAGDAAQGAAAVAVGQAARTGDGPGSPLRPASRSSPKSSDKSKSFSIDSILAGKQGQKPPSGDELLGGAKPGPGGRLGASLLAASSSLRPPFNASLMLDPHVQGGFYQLGIPFLSYFPLQVPDTVLHFQ

SEQ ID NO: 702 - protein, 467 aa, Human
MRPQELPRLAFPLLLLLLLLLPPPPCPAHSATRFDPTWESLDARQLPAWFDQAKFGIFIHWGVFSVPSFGSEWFWWYWQKEKIPKYVEFMKDNYPPSFKYEDFGPLFTAKFFNANQWADIFQASGAKYIVLTSKHHEGFTLWGSEYSWNWNAIDEGPKRDIVKELEVAIRNRTDLRFGLYYSLFEWFHPLFLEDESSSFHKRQFPVSKTLPELYELVNNYQPEVLWSDGDGGAPDQYWNSTGFLAWLYNESPVRGTVVTNDRWGAGSICKHGGFYTCSDRYNPGHLLPHKWENCMTIDKLSWGYRREAGISDYLTIEELVKQLVETVSCGGNLLMNIGPTLDGTISVVFEERLRQMGSWLKVNGEAIYETHTWRSQNDTVTPDVWYTSKPKEKLVYAIFLKWPTSGQLFLGHPKAILGATEVKLLGHGQPLNWISLEQNGIMVELPQLTIHQMPCKWGWALALTNVI

SEQ ID NO: 703 - protein, 486 aa, Human
MGPLSPARTLRLWGPRSLGVALGVFMTIGFALQLLGGPFQRRLPGLQLRQPSAPSLRPALPSCPPRQRLVFLKTHKSGSSSVLSLLHRYGDQHGLRFALPARYQFGYPKLFQASRVKGYRPQGGGTQLPFHILCHHMRFNLKEVLQVMPSDSFFFSIVRDPAALARSAFSYYKSTSSAFRKSPSLAAFLANPRGFYRPGARGDHYARNLLWFDFGLPFPPEKRAKRGNIHPPRDPNPPQLQVLPSGAGPRAQTLNPNALIHPVSTVTDHRSQISSPASFDLGSSSFIQWGLAWLDSVFDLVMVAEYFDESLVLLADALCWGLDDVVGFMHNAQAGHKQGLSTVSNSGLTAEDRQLTARARAWNNLDWALYVHFNRSLWARIEKYGQGRLQTAVAELRARREALAKHCLVGGEASDPKYITDRRFRPFQFGSAKVLGYILRSGLSPQDQEECERLATPELQYKDKLDAKQFPPTVSLPLKTSRPLSP

SEQ ID NO: 704 - protein, 242 aa, Human
MAAVKASTSKATRPWYSHPVYARYWQHYHQAMAWMQSHHNAYRKAVESCFNLPWYLPSALLPQSSYDNEAAYPQSFYDHHVAWQDYPCSSSHFRRSGQHPRYSSRIQASTKEDQALSKEEEMETESDAEVECDLSNMEITEELRQYFAETERHREERRRQQQLDAERLDSYVNADHDLYCNTRRSVEAPTERPGERRQAEMKRLYGDSAAKIQAMEAAVQLSFDKHCDRKQPKYWPVIPLKF

SEQ ID NO: 705 - protein, 298 aa, Human
MAARRALHFVFKVGNRFQTARFYRDVLGMKVLRHEEFEEGCKAACNGPYDGKWSKTMVGFGPEDDHFVAELTYNYGVGDYKLGNDFMGITLASSQAVSNARKLEWPLTEVAEGVFETEAPGGYKFYLQNRSLPQSDPVLKVTLAVSDLQKSLNYWCNLLGMKIYEKDEEKQRALLGYADNQCKLELQGVKGGVDHAAAFGRIAFSCPQKELPDLEDLMKRENQKILTPLVSLDTPGKATVQVVILADPDGHEICFVGDEAFRELSKMDPEGSKLLDDAMAADKSDEWFAKHNKPKASG

SEQ ID NO: 706 - protein, 782 aa, Human
MAPHRPAPALLCALSLALCALSLPVRAATASRGASQAGAPQGRVPEARPNSMVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMSVSLVADENPFAQGALKSEDCFILDHGKDGKIFVWKGKQANTEERKAALKTASDFITKMDYPKQTQVSVLPEGGETPLFKQFFKNWRDPDQTDGLGLSYLSSHIANVERVPFDAATLHTSTAMAAQHGMDDDGTGQKQIWRIEGSNKVPVDPATYGQFYGGDSYIILYNYRHGGRQGQIIYNWQGAQSTQDEVAASAILTAQLDEELGGTPVQSRVVQGKEPAHLMSLFGGKPMIIYKGGTSREGGQTAPASTRLFQVRANSAGATRAVEVLPKAGALNSNDAFVLKTPSAAYLWVGTGASEAEKTGAQELLRVLRAQPVQVAEGSEPDGFWEALGGKAAYRTSPRLKDKKMDAHPPRLFACSNKIGRFVIEEVPGELMQEDLATDDVMLLDTWDQVFVWVGKDSQEEEKTEALTSAKRYIETDPANRDRRTPITVVKQGFEPPSFVGWFLGWDDDYWSVDPLDRAMAELAA

SEQ ID NO: 707 - protein, 520 aa, Human
MPGSLPLNAEACWPKDVGIVALEIYFPSQYVDQAELEKYDGVDAGKYTIGLGQAKMGFCTDREDINSLCMTVVQNLMERNNLSYDCIGRLEVGTETIIDKSKSVKTNLMQLFEESGNTDIEGIDTTNACYGGTAAVFNAVNWIESSSWDGRYALVVAGDIAVYATGNARPTGGVGAVALLIGPNAPLIFERGLRGTHMQHAYDFYKPDMLSEYPIVDGKLSIQCYLSALDRCYSVYCKKIHAQWQKEGNDKDFTLNDFGFMIFHSPYCKLVQKSLARMLLNDFLNDQNRDKNSIYSGLEAFGDVKLEDTYFDRDVEKAFMKASSELFSQKTKASLLVSNQNGNMYTSSVYGSLASVLAQYSPQQLAGKRIGVFSYGSGLAATLYSLKVTQDATPGSALDKITASLCDLKSRLDSRTGVAPDVFAENMKLREDTHHLVNYIPQGSIDSLFEGTWYLVRVDEKHRRTYARRPTPNDDTLDEGVGLVHSNIATEHIPSPAKKVPRLPATAAEPEAAVISNGEH

SEQ ID NO: 708 - protein, 854 aa, Human
MPPCSGGDGSTPPGPSLRDRDCPAQSAEYPRDRLDPRPGSPSEASSPPFLRSRAPVNWYQEKAQVFLWHLMVSGSTTLLCLWKQPFHVSAFPVTASLAFRQSQGAGQHLYKDLQPFILLRLLMPEETQTQDQPMEEEEVETFAFQAEIAQLMSLIINTFYSNKEIFLRELISNSSDALDKIRYESLTDPSKLDSGKELHINLIPNKQDRTLTIVDTGIGMTKADLINNLGTIAKSGTKAFMEALQAGADISMIGQFGVGFYSAYLVAEKVTVITKHNDDEQYAWESSAGGSFTVRTDTGEPMGRGTKVILHLKEDQTEYLEERRIKEIVKKHSQFIGYPITLFVEKERDKEVSDDEAEEKEDKEEEKEKEEKESEDKPEIEDVGSDEEEEKKDGDKKKKKKIKEKYIDQEELNKTKPIWTRNPDDITNEEYGEFYKSLTNDWEDHLAVKHFSVEGQLEFRALLFVPRRAPFDLFENRKKKNNIKLYVRRVFIMDNCEELIPEYLNFIRGVVDSEDLPLNISREMLQQSKILKVIRKNLVKKCLELFTELAEDKENYKKFYEQFSKNIKLGIHEDSQNRKKLSELLRYYTSASGDEMVSLKDYCTRMKENQKHIYYITGETKDQVANSAFVERLRKHGLEVIYMIEPIDEYCVQQLKEFEGKTLVSVTKEGLELPEDEEEKKKQEEKKTKFENLCKIMKDILEKKVEKVVVSNRLVTSPCCIVTSTYGWTANMERIMKAQALRDNSTMGYMAAKKHLEINPDHSIIETLRQKAEADKNDKSVKDLVILLYETALLSSGFSLEDPQTHANRIYRMIKLGLGIDEDDPTADDTSAAVTEEMPPLEGDDDTSRMEEVD

SEQ ID NO: 709 - protein, 913 aa, Human
MDQSVAIQETLAEGEYCVIAVQGVLCEGDSRQSRLLGLVRYRLEHGGQEHALFLYTHRRMAITGDDVSLDQIVPVSRDFTLEEVSPDGELYILGSDVTVQLDTAELSLVFQLPFGSQTRMFLHEVARACPGFDSATRDPEFLWLSRYRCAELELEMPTPRGCNSALVTWPGYATIGGGGSNFDGLRPNGKGVPMDQSSRGQDKPESLQPRQNKSKSEITDMVRSSTITVSDKAHILSMQKFGLRDTIVKSHLLQKEEDYTYIQNFRFFAGTYNVNGQSPKECLRLWLSNGIQAPDVYCVGFQELDLSKEAFFFHDTPKEEEWFKAVSEGLHPDAKYAKVKLIRLVGIMLLLYVKQEHAAYISEVEAETVGTGIMGRMGNKGGVAIRFQFHNTSICVVNSHLAAHIEEYERRNQDYKDICSRMQFCQPDPSLPPLTISNHDVILWLGDLNYRIEELDVEKVKKLIEEKDFQMLYAYDQLKIQVAAKTVFEGFTEGELTFQPTYKYDTGSDDWDTSEKCRAPAWCDRILWKGKNITQLSYQSHMALKTSDHKPVSSVFDIGVRVVNDELYRKTLEEIVRSLDKMENANIPSVSLSKREFCFQNVKYMQLKVESFTIHNGQVPCHFEFINKPDEESYCKQWLNANPSRGFLLPDSDVEIDLELFVNKMTATKLNSGEDKIEDILVLHLDRGKDYFLSVSGNYLPSCFGSPIHTLCYMREPILDLPLETISELTLMPVWTGDDGSQLDSPMEIPKELWMMVDYLYRNAVQQEDLFQQPGLRSEFEHIRDCLDTGMIDNLSASNHSVAEALLLFLESLPEPVICYSTYHNCLECSGNYTASKQVISTLPIFHKNVFHYLMAFLRELLKNSAKNHLDENILASIFGSLLLRNPAGHQKLDMTEKKKAQEFIHQFLCNPL

SEQ ID NO: 710 - protein, 682 aa, Human
MAGGPGPGEPAAPGAQHFLYEVPPWVMCRFYKVMDALEPADWCQFAALIVRDQTELRLCERSGQRTASVLWPWINRNARVADLVHILTHLQLLRARDIITAWHPPAPLPSPGTTAPRPSSIPAPAEAEAWSPRKLPSSASTFLSPAFPGSQTHSGPELGLVPSPASLWPPPPSPAPSSTKPGPESSVSLLQGARPFPFCWPLCEISRGTHNFSEELKIGEGGFGCVYRAVMRNTVYAVKRLKENADLEWTAVKQSFLTEVEQLSRFRHPNIVDFAGYCAQNGFYCLVYGFLPNGSLEDRLHCQTQACPPLSWPQRLDILLGTARAIQFLHQDSPSLIHGDIKSSNVLLDERLTPKLGDFGLARFSRFAGSSPSQSSMVARTQTVRGTLAYLPEEYIKTGRLAVDTDTFSFGVVVLETLAGQRAVKTHGARTKYLKDLVEEEAEEAGVALRSTQSTLQAGLAADAWAAPIAMQIYKKHLDPRPGPCPPELGLGLGQLACCCLHRRAKRRPPMTQENSYVSSTGRAHSGAAPWQPLAAPSGASAQAAEQLQRGPNQPVESDESLGGLSAALRSWHLTPSCPLDPAPLREAGCPQGDTAGESSWGSGPGSRPTAVEGLALGSSASSSSEPPQIIINPARQKMVQKLALYEDGALDSLQLLSSSSLPGLGLEQDRQGPEESDEFQS

SEQ ID NO: 711 - protein, 142 aa, Human
MVLIDMSVDLSTQVVDHYENPRNVGSLDKTSKNVGTGLVGAPACGDVMKLQIQVDEKGKIVDARFKTFGCGSAIASSSLATEWVKGKTVEEALTIKNTDIAKELCLPPVKLHCSMLAEDAIKAALADYKLKQEPKKGEAEKK

SEQ ID NO: 712 - protein, 1176 aa, Human
MAERKGTAKVDFLKKIEKEIQQKWDTERVFEVNASNLEKQTSKGKYFVTFPYPYMNGRLHLGHTFSLSKCEFAVGYQRLKGKCCLFPFGLHCTGMPIKACADKLKREIELYGCPPDFPDEEEEEEETSVKTEDIIIKDKAKGKKSKAAAKAGSSKYQWGIMKSLGLSDEEIVKFSEAEHWLDYFPPLAIQDLKRMGLKVDWRRSFITTDVNPYYDSFVRWQFLTLRERNKIKFGKRYTIYSPKDGQPCMDHDRQTGEGVGPQEYTLLKLKVLEPYPSKLSGLKGKNIFLVAATLRPETMFGQTNCWVRPDMKYIGFETVNGDIFICTQKAARNMSYQGFTKDNGVVPVVKELMGEEILGASLSAPLTSYKVIYVLPMLTIKEDKGTGVVTSVPSDSPDDIAALRDLKKKQALRAKYGIRDDMVLPFEPVPVIEIPGFGNLSAVTICDELKIQSQNDREKLAEAKEKIYLKGFYEGIMLVDGFKGQKVQDVKKTIQKKMIDAGDALIYMEPEKQVMSRSSDECVVALCDQWYLDYGEENWKKQTSQCLKNLETFCEETRRNFEATLGWLQEHACSRTYGLGTHLPWDEQWLIESLSDSTIYMAFYTVAHLLQGGNLHGQAESPLGIRPQQMTKEVWDYVFFKEAPFPKTQIAKEKLDQLKQEFEFWYPVDLRVSGKDLVPNHLSYYLYNHVAMWPEQSDKWPTAVRANGHLLLNSEKMSKSTGNFLTLTQAIDKFSADGMRLALADAGDTVEDANFVEAMADAGILRLYTWVEWVKEMVANWDSLRSGPASTFNDRVFASELNAGIIKTDQNYEKMMFKEALKTGFFEFQAAKDKYRELAVEGMHRELVFRFIEVQTLLLAPFCPHLCEHIWTLLGKPDSIMNASWPVAGPVNEVLIHSSQYLMEVTHDLRLRLKNYMMPAKGKKTDKQPLQKPSHCTIYVAKNYPPWQHTTLSVLRKHFEANNGKLPDNKVIASELGSMPELKKYMKKVMPFVAMIKENLEKMGPRILDLQLEFDEKAVLMENIVYLTNSLELEHIEVKFASEAEDKIREDCCPGKPLNVFRIEPGVSVSLVNPQPSNGHFSTKIEIRQGDNCDSIIRRLMKMNRGIKDLSKVKLMRFDDPLLGPRRVPVLGKEYTEKTPISEHAVFNVDLMSKKIHLTENGIRVDIGDTIIYLVH

SEQ ID NO: 713 - protein, 666 aa, Human
MRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPIGTLRPFLNWTGPPEPIEAAVARFFSASCVPGADKGQFPNLCRLCAGTGENKCAFSSQEPYFSYSGAFKCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALVLKGEADAMSLDGGYVYTAGKCGLVPVLAENYKSQQSSDPDPNCVDRPVEGYLAVAVVRRSDTSLTWNSVKGKKSCHTAVDRTAGWNIPMGLLFNQTGSCKFDEYFSQSCAPGSDPRSNLCALCIGDEQGENKCVPNSNERYYGYTGAFRCLAENAGDVAFVKDVTVLQNTDGNNNEAWAKDLKLADFALLCLDGKRKPVTEARSCHLAMAPNHAVVSRMDKVERLKQVLLHQQAKFGRNGSDCPDKFCLFQSETKNLLFNDNTECLARLHGKTTYEKYLGPQYVAGITNLKKCSTSPLLEACEFLRK

SEQ ID NO: 714 - protein, 863 aa, Human
MVQKESQATLEERESELSSNPAASAGASLEPPAAPAPGEDNPAGAGGAAVAGAAGGARRFLCGVVEGFYGRPWVMEQRKELFRRLQKWELNTYLYAPKDDYKHRMFWREMYSVEEAEQLMTLISAAREYEIEFIYAISPGLDITFSNPKEVSTLKRKLDQVSQFGCRSFALLFDDIDHNMCAADKEVFSSFAHAQVSITNEIYQYLGEPETFLFCPTEYCGTFCYPNVSQSPYLRTVGEKLLPGIEVLWTGPKVVSKEIPVESIEEVSKIIKRAPVIWDNIHANDYDQKRLFLGPYKGRSTELIPRLKGVLTNPNCEFEANYVAIHTLATWYKSNMNGVRKDVVMSRQVAHSGAKASVVDGTPLVAAPSLNATTVVTTVYQEPIMSQGAALSGEPTTLTKEEEKKQPDEEPMDMVVEKQEETDHKNDNQILSEIVEAKMAEELKPMDTDKESIAESKSPEMSMQEDCISDIAPMQTDEQTNKEQFVPGPNEKPLYTAEPVTLEDLQLLADLFYLPYEHGPKGAQMLREFQWLRANSSVVSVNCKGKDSEKIEEWRSRAAKFEEMCGLVMGMFTRLSNCANRTILYDMYSYVWDIKSIMSMVKSFVQWLGCRSHSSAQFLIGDQEPWAFRGGLAGEFQRLLPIDGANDLFFQPPPLTPTSKVYTIRPYFPKDEASVYKICREMYDDGVGLPFQSQPDLIGDKLVGGLLSLSLDYCFVLEDEDGICGYALGTVDVTPFIKKCKISWIPFMQEKYTKPNGDKELSEAEKIMLSFHEEQEVLPETFLANFPSLIKMDIHKKVTDPSVAKSMMACLLSSLKANGSRGAFCEVRPDDKRILEFYSKLGCFEIAKMEGFPKDVVILGRSL

SEQ ID NO: 715 - protein, 451 aa, Human
MAAPEPLSPAGGAGEEAPEEDEDEAEAEDPERPNAGAGGGRSGGGGSSVSGGGGGGGAGAGGCGGPGGALTRRAVTLRVLLKDALLEPGAGVLSIYYLGKKFLGDLQPDGRIMWQETGQTFNSPSAWATHCKKLVNPAKKSGCGWASVKYKGQKLDKYKATWLRLHQLHTPATAADESPASEGEEEELLMEEEEEDVLAGVSAEDKSRRPLGKSPSEPAHPEATTPGKRVDSKIRVPVRYCMLGSRDLARNPHTLVEVTSFAAINKFQPFNVAVSSNVLFLLIYQSLFLRGLSLVGWYHSHPHSPALPSLQDIDAQMDYQLRLQGSSNGFQPCLALLCSPYYSGNPGPESKISPFWVMPPPEQRPSDYGIPMDVEMAYVQDSFLTNDILHEMMLLVEFYKGSPDLVRLQEPWSQEHTYLDKLKISLASRTPKDQSLCHVLEQVCGVLKQGS

SEQ ID NO: 716 - protein, 1137 aa, Human
MSRRKPASGGLAASSSAPARQAVLSRFFQSTGSLKSTSSSTGAADQVDPGAAAAAAAAAAAAPPAPPAPAFPPQLPPHIATEIDRRKKRPLENDGPVKKKVKKVQQKEGGSDLGMSGNSEPKKCLRTRNVSKSLEKLKEFCCDSALPQSRVQTESLQERFAVLPKCTDFDDISLLHAKNAVSSEDSKRQINQKDTTLFDLSQFGSSNTSHENLQKTASKSANKRSKSIYTPLELQYIEMKQQHKDAVLCVECGYKYRFFGEDAEIAARELNIYCHLDHNFMTASIPTHRLFVHVRRLVAKGYKVGVVKQTETAALKAIGDNRSSLFSRKLTALYTKSTLIGEDVNPLIKLDDAVNVDEIMTDTSTSYLLCISENKENVRDKKKGNIFIGIVGVQPATGEVVFDSFQDSASRSELETRMSSLQPVELLLPSALSEQTEALIHRATSVSVQDDRIRVERMDNIYFEYSHAFQAVTEFYAKDTVDIKGSQIISGIVNLEKPVICSLAAIIKYLKEFNLEKMLSKPENFKQLSSKMEFMTINGTTLRNLEILQNQTDMKTKGSLLWVLDHTKTSFGRRKLKKWVTQPLLKLREINARLDAVSEVLHSESSVFGQIENHLRKLPDIERGLCSIYHKKCSTQEFFLIVKTLYHLKSEFQAIIPAVNSHIQSDLLRTVILEIPELLSPVEHYLKILNEQAAKVGDKTELFKDLSDFPLIKKRKDEIQGVIDEIRMHLQEIRKILKNPSAQYVTVSGQEFMIEIKNSAVSCIPTDWVKVGSTKAVSRFHSPFIVENYRHLNQLREQLVLDCSAEWLDFLEKFSEHYHSLCKAVHHLATVDCIFSLAKVAKQGDYCRPTVQEERKIVIKNGRHPVIDVLLGEQDQYVPNNTDLSEDSERVMIITGPNMGGKSSYIKQVALITIMAQIGSYVPAEEATIGIVDGIFTRMGAADNIYKGQSTFMEELTDTAEIIRKATSQSLVILDELGRGTSTHDGIAIAYATLEYFIRDVKSLTLFVTHYPPVCELEKNYSHQVGNYHMGFLVSEDESKLDPGAAEQVPDFVTFLYQITRGIAARSYGLNVAKLADVPGEILKKAAHKSKELEGLINTKRKRLKYFAKLWTMHNAQDLQKWTEEFNMEETQTSLLH

SEQ ID NO: 717 - protein, 709 aa, Human
MATAGGGSGADPGSRGLLRLLSFCVLLAGLCRGNSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQCYQDHNLSQNGSAPTFPLCAMQLFSHMHAVISTATCMRRSSIQSTFSINPEIVCDPLSDYNVWSMLKPINTTGTLKPDDRVVVAATRLDSRSFFWNVAPGAESAVASFVTQLAAAEALQKAPDVTTLPRNVMFVFFQGETFDYIGSSRMVYDMEKGKFPVQLENVDSFVELGQVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEEDLNFVTDTAKALADVATVLGRALYELAGGTNFSDTVQADPQTVTRLLYGFLIKANNSWFQSILRQDLRSYLGDGPLQHYIAVSSPTNTTYVVQYALANLTGTVVNLTREQCQDPSKVPSENKDLYEYSWVQGPLHSNETDRLPRCVRSTARLARALSPAFELSQWSSTEYSTWTESRWKDIRARIFLIASKELELITLTVGFGILIFSLIVTYCINAKADVLFIAPREPGAVSY

SEQ ID NO: 718 - protein, 415 aa, Human
MTGERPSTALPDRRWGPRILGFWGGCRVWVFAAIFLLLSLAASWSKAENDFGLVQPLVTMEQLLWVSGRQIGSVDTFRIPLITATPRGTLLAFAEARKMSSSDEGAKFIALRRSMDQGSTWSPTAFIVNDGDVPDGLNLGAVVSDVETGVVFLFYSLCAHKAGCQVASTMLVWSKDDGVSWSTPRNLSLDIGTEVFAPGPGSGIQKQREPRKGRLIVCGHGTLERDGVFCLLSDDHGASWRYGSGVSGIPYGQPKQENDFNPDECQPYELPDGSVVINARNQNNYHCHCRIVLRSYDACDTLRPRDVTFDPELVDPVVAAGAVVTSSGIVFFSNPAHPEFRVNLTLRWSFSNGTSWRKETVQLWPGPSGYSSLATLEGSMDGEEQAPQLYVLYEKGRNHYTESISVAKISVYGTL

SEQ ID NO: 719 - protein, 508 aa, Human
MLRRALLCLAVAALVRADAPEEEDHVLVLRKSNFAEALAAHKYLLVEFYAPWCGHCKALAPEYAKAAGKLKAEGSEIRLAKVDATEESDLAQQYGVRGYPTIKFFRNGDTASPKEYTAGREADDIVNWLKKRTGPAATTLPDGAAAESLVESSEVAVIGFFKDVESDSAKQFLQAAEAIDDIPFGITSNSDVFSKYQLDKDGVVLFKKFDEGRNNFEGEVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPESEELTAERITEFCHRFLEGKIKPHLMSQELPEDWDKQPVKVLVGKNFEDVAFDEKKNVFVEFYAPWCGHCKQLAPIWDKLGETYKDHENIVIAKMDSTANEVEAVKVHSFPTLKFFPASADRTVIDYNGERTLDGFKKFLESGGQDGAGDDDDLEDLEEAEEPDMEEDDDQKAVKDEL

SEQ ID NO: 720 - protein, 1290 aa, Human
MSGPLEGADGGGDPRPGESFCPGGVPSPGPPQHRPCPGPSLADDTDANSNGSSGNESNGHESRGASQRSSHSSSSGNGKDSALLETTESSKSTNSQSPSPPSSSIAYSLLSASSEQDNPSTSGCSSEQSARARTQKELMTALRELKLRLPPERRGKGRSGTLATLQYALACVKQVQANQEYYQQWSLEEGEPCSMDMSTYTLEELEHITSEYTLQNQDTFSVAVSFLTGRIVYISEQAAVLLRCKRDVFRGTRFSELLAPQDVGVFYGSTAPSRLPTWGTGASAGSGLRDFTQEKSVFCRIRGGPDRDPGPRYQPFRLTPYVTKIRVSDGAPAQPCCLLIAERIHSGYEAPRIPPDKRIFTTRHTPSCLFQDVDERAAPLLGYLPQDLLGAPVLLFLHPEDRPLMLAIHKKILQLAGQPFDHSPIRFCARNGEYVTMDTSWAGFVHPWSRKVAFVLGRHKVRTAPLNEDVFTPPAPSPAPSLDTDIQELSEQIHRLLLQPVHSPSPTGLCGVGAVTSPGPLHSPGSSSDSNGGDAEGPGPPAPVTFQQICKDVHLVKHQGQQLFIESRARPQSRPRLPATGTFKAKALPCQSPDPELEAGSAPVQAPLALVPEEAERKEASSCSYQQINCLDSILRYLESCNLPSTTKRKCASSSSYTTSSASDDDRQRTGPVSVGTKKDPPSAALSGEGATPRKEPVVGGTLSPLALANKAESVVSVTSQCSFSSTIVHVGDKKPPESDIIMMEDLPGLAPGPAPSPAPSPTVAPDPAPDAYRPVGLTKAVLSLHTQKEEQAFLSRFRDLGRLRGLDSSSTAPSALGERGCHHGPAPPSRRHHCRSKAKRSRHHQNPRAEAPCYVSHPSPVPPSTPWPTPPATTPFPAVVQPYPLPVFSPRGGPQPLPPAPTSVPPAAFPAPLVTPMVALVLPNYLFPTPSSYPYGALQTPAEGPPTPASHSPSPSLPALAPSPPHRPDSPLFNSRCSSPLQLNLLQLEELPRAEGAAVAGGPGSSAGPPPPSAEAAEPEARLAEVTESSNQDALSGSSDLLELLLQEDSRSGTGSAASGSLGSGLGSGSGSGSHEGGSTSASITRSSQSSHTSKYFGSIDSSEAEAGAARGGAEPGDQVIKYVLQDPIWLLMANADQRVMMTYQVPSRDMTSVLKQDRERLRAMQKQQPRFSEDQRRELGAVHSWVRKGQLPRALDVMACVDCGSSTQDPGHPDDPLFSELDGLGLEPMEEGGGEQGSSGGGSGEGEGCEEAQGGAKASSSQDLAMEEEEEGRSSSSPALPTAGNCTS

SEQ ID NO: 721 - protein, 377 aa, Human
MASSEQAEQPSQPSSTPGSENVLPREPLIATAVKFLQNSRVRQSPLATRRAFLKKKGLTDEEIDMAFQQSGTAADEPSSLGPATQVVPVQPPHLISQPYSPAGSRWRDYGALAIIMAGIAFGFHQLYKKYLLPLILGGREDRKQLERMEAGLSELSGSVAQTVTQLQTTLASVQELLIQQQQKIQELAHELAAAKATTSTNWILESQNINELKSEINSLKGLLLNRRQFPPSPSAPKIPSWQIPVKSPSPSSPAAVNHHSSSDISPVSNESTSSSPGKEGHSPEGSTVTYHLLGPQEEGEGVVDVKGQVRMEVQGEEEKREDKEDEEDEEDDDVSHVDEEDCLGVQREDRRGGDGQINEQVEKLRRPEGASNESERD

SEQ ID NO: 722 - protein, 304 aa, Human
MKFLIFAFFGGVHLLSLCSGKAICKNGISKRTFEEIKEEIASCGDVAKAIINLAVYGKAQNRSYERLALLVDTVGPRLSGSKNLEKAIQIMYQNLQQDGLEKVHLEPVRIPHWERGEESAVMLEPRIHKIAILGLGSSIGTPPEGITAEVLVVTSFDELQRRASEARGKIVVYNQPYINYSRTVQYRTQGAVEAAKVGALASLIRSVASFSIYRAFSRVNCFVDTVTGSGNSPCEKYILTLKTFKYMTRMSLECDKFFTFSLPFANSGVRSYCREHSQPSVEIHLKQMCLLLNKHGMFKSIFIY

SEQ ID NO: 723 - protein, 1756 aa, Human
MNSLFRKRNKGKYSPTVQTRSISNKELSELIEQLQKNADQVEKNIVDTEAKMQSDLARLQEGRQPEHRDVTLQKVLDSEKLLYVLEADAAIAKHMKHPQGDMIAEDIRQLKERVTNLRGKHKQIYRLAVKEVDPQVNWAALVEEKLDKLNNQSFGTDLPLVDHQVEEHNIFHNEVKAIGPHLAKDGDKEQNSELRAKYQKLLAASQARQQHLSSLQDYMQRCTNELYWLDQQAKGRMQYDWSDRNLDYPSRRRQYENFINRNLEAKEERINKLHSEGDQLLAAEHPGRNSIEAHMEAVHADWKEYLNLLICEESHLKYMEDYHQFHEDVKDAQELLRKVDSDLNQKYGPDFKDRYQIELLLRELDDQEKVLDKYEDVVQGLQKRGQQVVPLKYRRETPLKPIPVEALCDFEGEQGLISRGYSYTLQKNNGESWELMDSAGNKLIAPAVCFVIPPTDPEALALADSLGSQYRSVRQKAAGSKRTLQQRYEVLKTENPGDASDLQGRQLLAGLDKVASDLDRQEKAITGILRPPLEQGRAVQDSAERAKDLKNITNELLRIEPEKTRSTAEGEAFIQALPGSGTTPLLRTRVEDTNRKYEHLLQLLDLAQEKVDVANRLEKSLQQSWELLATHENHLNQDDTVPESSRVLDSKGQELAAMACELQAQKSLLGEVEQNLQAAKQCSSTLASRFQEHCPDLERQEAEVHKLGQRFNNLRQQVERRAQSLQSAKAAYEHFHRGHDHVLQFLVSIPSYEPQETDSLSQMETKLKNQKNLLDEIASREQEVQKICANSQQYQQAVKDYELEAEKLRSLLDLENGRSSHVSKRARLQSPATKVKEEEAALAAKFTEVYAINRQRLQNLEFALNLLRQQPEVEVTHETLQRNRPDSGVEEAWKIRKELDEETERRRQLENEVKSTQEEIWTLRNQGPQESVVRKEVLKKVPDPVLEESFQQLQRTLAEEQHKNQLLQEELEALQLQLRALEQETRDGGQEYVVKEVLRIEPDRAQADEVLQLREELEALRRQKGAREAEVLLLQQRVAALAEEKSRAQEKVTEKEVVKLQNDPQLEAEYQQLQEDHQRQDQLREKQEEELSFLQDKLKRLEKERAMAEGKITVKEVLKVEKDAATEREVSDLTRQYEDEAAKARASQREKTELLRKIWALEEENAKVVVQEKVREIVRPDPKAESEVANLRLELVEQERKYRGAEEQLRSYQSELEALRRRGPQVEVKEVTKEVIKYKTDPEMEKELQRLREEIVDKTRLIERCDLEIYQLKKEIQALKDTKPQVQTKEVVQEILQFQEDPQTKEEVASLRAKLSEEQKKQVDLERERASQEEQIARKEEELSRVKERVVQQEVVRYEEEPGLRAEASAFAESIDVELRQIDKLRAELRRLQRRRTELERQLEELERERQARREAEREVQRLQQRLAALEQEEAEAREKVTHTQKVVLQQDPQQAREHALLRLQLEEEQHRRQLLEGELETLRRKLAALEKAEVKEKVVLSESVQVEKGDTEQEIQRLKSSLEEESRSKRELDVEVSRLEARLSELEFHNSKSSKELDFLREENHKLQLERQNLQLETRRLQSEINMAATETRDLRNMTVADSGTNHDSRLWSLERELDDLKRLSKDKDLEIDELQKRLGSVAVKREQRENHLRRSIVVIHPDTGRELSPEEAHRAGLIDWNMFVKLRSQECDWEEISVKGPNGESSVIHDRKSGKKFSIEEALQSGRLTPAQYDRYVNKDMSIQELAVLVSGQK

SEQ ID NO: 724 - protein, 381 aa, Human
MASPPACPSEEDESLKGCELYVQLHGIQQVLKDCIVHLCISKPERPMKFLREHFEKLEKEENRQILARQKSNSQSDSHDEEVSPTPPNPVVKARRRRGGVSAEVYTEEDAVSYVRKVIPKDYKTMTALAKAISKNVLFAHLDDNERSDIFDAMFPVTHIAGETVIQQGNEGDNFYVVDQGEVDVYVNGEWVTNISEGGSFGELALIYGTPRAATVKAKTDLKLWGIDRDSYRRILMGSTLRKRKMYEEFLSKVSILESLEKWERLTVADALEPVQFEDGEKIVVQGEPGDDFYIITEGTASVLQRRSPNEEYVEVGRLGPSDYFGEIALLLNRPRAATVVARGPLKCVKLDRPRFERVLGPCSEILKRNIQRYNSFISLTV

SEQ ID NO: 725 - protein, 533 aa, Human
MNYEGARSERENHAADDSEGGALDMCCSERLPGLPQPIVMEALDEAEGLQDSQREMPPPPPPSPPSDPAQKPPPRGAGSHSLTVRSSLCLFAASQFLLEPTAWLDSGTWGVPSLLLVFLSVGLVLVTTLVWHLLRTPPEPPTPLPPEDRRQSVSRQPSFTYSEWMEEKIEDDFLDLDPVPETPVFDCVMDIKPEADPTSLTVKSMGLQERRGSNVSLTLDMCTPGCNEEGFGYLMSPREESAREYLLSASRVLQAEELHEKALDPFLLQAEFFEIPMNFVDPKEYDIPGLVRKNRYKTILPNPHSRVCLTSPDPDDPLSSYINANYIRGYGGEEKVYIATQGPIVSTVADFWRMVWQEHTPIIVMITNIEEMNEKCTEYWPEEQVAYDGVEITVQKVIHTEDYRLRLISLKSGTEERGLKHYWFTSWPDQKTPDRAPPLLHLVREVEEAAQQEGPHCAPIIVHCSAGIGRTGCFIATSICCQQLRQEGVVDILKTTCQLRQDRGGMIQTCEQYQFVHHVMSLYEKQLSHQSPE

SEQ ID NO: 726 - protein, 218 aa, Human
MGTRDDEYDYLFKVVLIGDSGVGKSNLLSRFTRNEFNLESKSTIGVEFATRSIQVDGKTIKAQIWDTAGQERYRAITSAYYRGAVGALLVYDIAKHLTYENVERWLKELRDHADSNIVIMLVGNKSDLRHLRAVPTDEARAFAEKNNLSFIETSALDSTNVEEAFKNILTEIYRIVSQKQIADRAAHDESPGNNVVDISVPPTTDGQKPNKLQCCQNL

SEQ ID NO: 727 - protein, 637 aa, Human
MAGGAGWSGAPAALLRSVRRLREVFEVCGRDPDGFLRVERVAALGLRFGQGEEVEKLVKYLDPNDLGRINFKDFCRGVFAMKGCEELLKDVLSVESAGTLPCAPEIPDCVEQGSEVTGPTFADGELIPREPGFFPEDEEEAMTLAPPEGPQELYTDSPMESTQSLEGSVGSPAEKDGGLGGLFLPEDKSLVHTPSMTTSDLSTHSTTSLISNEEQFEDYGEGDDVDCAPSSPCPDDETRTNVYSDLGSSVSSSAGQTPRKMRHVYNSELLDVYCSQCCKKINLLNDLEARLKNLKANSPNRKISSTAFGRQLMHSSNFSSSNGSTEDLFRDSIDSCDNDITEKVSFLEKKVTELENDSLTNGDLKSKLKQENTQLVHRVHELEEMVKDQETTAEQALEEEARRHREAYGKLEREKATEVELLNARVQQLEEENTELRTTVTRLKSQTEKLDEERQRMSDRLEDTSLRLKDEMDLYKRMMDKLRQNRLEFQKEREATQELIEDLRKELEHLQMYKLDCERPGRGRSASSGLGEFNARAREVELEHEVKRLKQENYKLRDQNDDLNGQILSLSLYEAKNLFAAQTKAQSLAAEIDTASRDELMEALKEQEEINFRLRQYMDKIILAILDHNPSILEIKH

SEQ ID NO: 728 - protein, 446 aa, Human
MEASFVQTTMALGLSSKKASSRNVAVERKNLITVCRFSVKTLLEKYTAEPIDDSSEEFVNFAAILEQILSHRFKACAPAGPVSWFSSDGQRGFWDYIRLACSKVPNNCVSSIENMENISTARAKGRAWIRVALMEKRMSEYITTALRDTRTTRRFYDSGAIMLRDEATILTGMLIGLSAIDFSFCLKGEVLDGKTPVVIDYTPYLKFTQSYDYLTDEEERHSAESSTSEDNSPEHPYLPLVTDEDSWYSKWHKMEQKFRIVYAQKGYLEELVRLRESQLKDLEAENRRLQLQLEEAAAQNQREKRELEGVILELQEQLTGLIPSDHAPLAQGSKELTTPLVNQWPSLGTLNGAEGASNSKLYRRHSFMSTEPLSAEASLSSDSQRLGEGTRDEEPWGPIGKDPTPSMLGLCGSLASIPSCKSLASFKSNECLVSDSPEGSPALSPS

SEQ ID NO: 729 - protein, 180 aa, Human
MASTISAYKEKMKELSVLSLICSCFYTQPHPNTVYQYGDMEVKQLDKRASGQSFEVILKSPSDLSPESPMLSSPPKKKDTSLEELQKRLEAAEERRKTQEAQVLKQLAERREHEREVLHKALEENNNFSRQAEEKLNYKMELSKEIREAHLAALRERLREKELHAAEVRRNKEQREEMSG

SEQ ID NO: 730 - protein, 216 aa, Human
MTLAAYKEKMKELPLVSLFCSCFLADPLNKSSYKYEGWCGRQCRRKDESQRKDSADWRERRAQADTVDLNWCVISDMEVIELNKCTSGQSFEVILKPPSFDGVPEFNASLPRRRDPSLEEIQKKLEAAEERRKYQEAELLKHLAEKREHEREVIQKAIEENNNFIKMAKEKLAQKMESNKENREAHLAAMLERLQEKDKHAEEVRKNKELKEEASR

SEQ ID NO: 731 - protein, 592 aa, Human
MAPPVAERGLKSVVWQKIKATVFDDCKKEGEWKIMLLDEFTTKLLASCCKMTDLLEEGITVVENIYKNREPVRQMKALYFITPTSKSVDCFLHDFASKSENKYKAAYIYFTDFCPDNLFNKIKASCSKSIRRCKEINISFIPHESQVYTLDVPDAFYYCYSPDPGNAKGKDAIMETMADQIVTVCATLDENPGVRYKSKPLDNASKLAQLVEKKLEDYYKIDEKSLIKGKTHSQLLIIDRGFDPVSTVLHELTFQAMAYDLLPIENDTYKYKTDGKEKEAILEEEDDLWVRIRHRHIAVVLEEIPKLMKEISSTKKATEGKTSLSALTQLMKKMPHFRKQITKQVVHLNLAEDCMNKFKLNIEKLCKTEQDLALGTDAEGQKVKDSMRVLLPVLLNKNHDNCDKIRAILLYIFSINGTTEENLDRLIQNVKIENESDMIRNWSYLGVPIVPQSQQGKPLRKDRSAEETFQLSRWTPFIKDIMEDAIDNRLDSKEWPYCSQCPAVWNGSGAVSARQKPRANYLEDRKNGSKLIVFVIGGITYSEVRCAYEVSQAHKSCEVIIGSTHVLTPKKLLDDIKMLNKPKDKVSLIKDE

SEQ ID NO: 732 - protein, 318 aa, Human
MAGRSLTSKAEPTAGAVDRAEKAGGQDTSSQKIEDLMEMVQKLQKVGSLEPRVEVLINRINEVQQAKKKANKDLGEARTICEALQKELDSLHGEKVHLKEILSKKQETLRILRLHCQEKESEAHRKHTMLQECKERISALNLQIEEEKNKQRQLRLAFEEQLEDLMGQHKDLWDFHMPERLAKEICALDSSKEQLLKEEKLVKATLEDVKHQLCSLCGAEGPSTLDEGLFLRSQEAAATVQLFQEEHRKAEELLAAAAQRHQQLQQKCQQQQQKRQRLKEELEKHGMQVPAQAQSTQEEEAGPGDVAPRPGRPVTWWS

SEQ ID NO: 733 - protein, 1192 aa, Human
MALSDEPAAGGPEEEAEDETLAFGAALEAFGESAETRALLGRLREVHGGGAEREVALERFRVIMDKYQEQPHLLDPHLEWMMNLLLDIVQDQTSPASLVHLAFKFLYIITKVRGYKTFLRLFPHEVADVEPVLDLVTIQNPKDHEAWETRYMLLLWLSVTCLIPFDFSRLDGNLLTQPGQARMSIMDRILQIAESYLIVSDKARDAAAVLVSRFITRPDVKQSKMAEFLDWSLCNLARSSFQTMQGVITMDGTLQALAQIFKHGKREDCLPYAATVLRCLDGCRLPESNQTLLRKLGVKLVQRLGLTFLKPKVAAWRYQRGCRSLAANLQLLTQGQSEQKPLILTEDDDEDDDVPEGVERVIEQLLVGLKDKDTVVRWSAAKGIGRMAGRLPRALADDVVGSVLDCFSFQETDKAWHGGCLALAELGRRGLLLPSRLVDVVAVILKALTYDEKRGACSVGTNVRDAACYVCWAFARAYEPQELKPFVTAISSALVIAAVFDRDINCRRAASAAFQENVGRQGTFPHGIDILTTADYFAVGNRSNCFLVISVFIAGFPEYTQPMIDHLVTMKISHWDGVIRELAARALHNLAQQAPEFSATQVFPRLLSMTLSPDLHMRHGSILACAEVAYALYKLAAQENRPVTDHLDEQAVQGLKQIHQQLYDRQLYRGLGGQLMRQAVCVLIEKLSLSKMPFRGDTVIDGWQWLINDTLRHLHLISSHSRQQMKDAAVSALAALCSEYYMKEPGEADPAIQEELITQYLAELRNPEEMTRCGFSLALGALPGFLLKGRLQQVLTGLRAVTHTSPEDVSFAESRRDGLKAIARICQTVGVKAGAPDEAVCGENVSQIYCALLGCMDDYTTDSRGDVGTWVRKAAMTSLMDLTLLLARSQPELIEAHTCERIMCCVAQQASEKIDRFRAHAASVFLTLLHFDSPPIPHVPHRGELEKLFPRSDVASVNWSAPSQAFPRITQLLGLPTYRYHVLLGLVVSLGGLTESTIRHSTQSLFEYMKGIQSDPQALGSFSGTLLQIFEDNLLNERVSVPLLKTLDHVLTHGCFDIFTTEEDHPFAVKLLALCKKEIKNSKDIQKLLSGIAVFCEMVQFPGDVRRQALLQLCLLLCHRFPLIRKTTASQVYETLLTYSDVVGADVLDEVVTVLSDTAWDAELAVVREQRNRLCDLLGVPRPQLVPQPGAC

SEQ ID NO: 734 - protein, 1093 aa, Human
MSWFNASQLSSFAKQALSQAQKSIDRVLDIQEEEPSIWAETIPYGEPGISSPVSGGWDTSTWGLKSNTEPQSPPIASPKAITKPVRRTVVDESENFFSAFLSPTDVQTIQKSPVVSKPPAKSQRPEEEVKSSLHESLHIGQSRTPETTESQVKDSSLCVSGETLAAGTSSPKTEGKHEETVNKESDMKVPTVSLKVSESVIDVKTTMESISNTSTQSLTAETKDIALEPKEQKHEDRQSNTPSPPVSTFSSGTSTTSDIEVLDHESVISESSASSRQETTDSKSSLHLMQTSFQLLSASACPEYNRLDDFQKLTESCCSSDAFERIDSFSVQSLDSRSVSEINSDDELSGKGYALVPIIVNSSTPKSKTVESAEGKSEEVNETLVIPTEEAEMEESGRSATPVNCEQPDILVSSTPINEGQTVLDKVAEQCEPAESQPEALSEKEDVCKTVEFLNEKLEKREAQLLSLSKEKALLEEAFDNLKDEMFRVKEESSSISSLKDEFTQRIAEAEKKVQLACKERDAAKKEIKNIKEELATRLNSSETADLLKEKDEQIRGLMEEGEKLSKQQLHNSNIIKKLRAKDKENENMVAKLNKKVKELEEELQHLKQVLDGKEEVEKQHRENIKKLNSMVERQEKDLGRLQVDMDELEEKNRSIQAALDSAYKELTDLHKANAAKDSEAQEAALSREMKAKEELSAALEKAQEEARQQQETLAIQVGDLRLALQRTEQAAARKEDYLRHEIGELQQRLQEAENRNQELSQSVSSTTRPLLRQIENLQATLGSQTSSWEKLEKNLSDRLGESQTLLAAAVERERAATEELLANKIQMSSMESQNSLLRQENSRFQAQLESEKNRLCKLEDENNRYQVELENLKDEYVRTLEETRKEKTLLNSQLEMERMKVEQERKKAIFTQETIKEKERKPFSVSSTPTMSRSSSISGVDMAGLQTSFLSQDESHDHSFGPMPISANGSNLYDAVRMGAGSSIIENLQSQLKLREGEITHLQLEIGNLEKTRSIMAEELVKLTNQNDELEEKVKEIPKLRTQLRDLDQRYNTILQMYGEKAEEAEELRLDLEDVKNMYKTQIDELLRQSLS

SEQ ID NO: 735 - protein, 167 aa, Human
MSLLRSLRVFLVARTGSYPAGSLLRQSPQPRHTFYAGPRLSASASSKELLMKLRRKTGYSFVNCKKALETCGGDLKQAEIWLHKEAQKEGWSKAAKLQGRKTKEGLIGLLQEGNTTVLVEVNCETDFVSRNLKFQLLVQQVALGTMMHCQTLKDQPSAYSKENWEKT

SEQ ID NO: 736 - protein, 648 aa, Human
MGCAEGKAVAAAAPTELQTKGKNGDGRRRSAKDHHPGKTLPENPAGFTSTATADSRALLQAYIDGHSVVIFSRSTCTRCTEVKKLFKSLCVPYFVLELDQTEDGRALEGTLSELAAETDLPVVFVKQRKIGGHGPTLKAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGCG

SEQ ID NO: 737 - protein, 422 aa, Human
MQQPQPQGQQQPGPGQQLGGQGAAPGAGGGPGGGPGPGPCLRRELKLLESIFHRGHERFRIASACLDELSCEFLLAGAGGAGAGAAPGPHLPPRGSVPGDPVRIHCNITESYPAVPPIWSVESDDPNLAAVLERLVDIKKGNTLLLQHLKRIISDLCKLYNLPQHPDVEMLDQPLPAEQCTQEDVSSEDEDEEMPEDTEDLDHYEMKEEEPAEGKKSEDDGIGKENLAILEKIKKNQRQDYLNGAVSGSVQATDRLMKELRDIYRSQSFKGGNYAVELVNDSLYDWNVKLLKVDQDSALHNDLQILKEKEGADFILLNFSFKDNFPFDPPFVRVVSPVLSGGYVLGGGAICMELLTKQGWSSAYSIESVIMQISATLVKGKARVQFGANKSQYSLTRAQQSYKSLVQIHEKNGWYTPPKEDG

SEQ ID NO: 738 - protein, 359 aa, Human
MRMDSLTEEKLECRLWCCLSDPSPPGLAARCCVLERSIVPSLRQESYPSSSPIWFVDSEDPNLTSVLERLEDTKNNNLLRQQLKWLICELCSLYNLPKHLDVEMLDQPLPTGQNGTTEEVTSEEEEEEEEMAEDIEDLDHYEMKEEEPISGKKSEDEGIEKENLAILEKIRKTQRQDHLNGAVSGSVQASDRLMKELRDIYRSQSYKTGIYSVELINDSLYDWHVKLQKVDPDSPLHSDLQILKEKEGIEYILLNFSFKDNFPFDPPFVRVVLPVLSGGYVLGGGALCMELLTKQGWSSAYSIESVIMQINATLVKGKARVQFGANKNQYNLARAQQSYNSIVQIHEKNGWYTPPKEDG

SEQ ID NO: 739 - protein, 354 aa, Human
MAESPTEEAATAGAGAAGPGASSVAGVVGVSGSGGGFGPPFLPDVWAAAAAAGGAGGPGSGLAPLPGLPPSAAAHGAALLSHWDPTLSSDWDGERTAPQCLLRIKRDIMSIYKEPPPGMFVVPDTVDMTKIHALITGPFDTPYEGGFFLFVFRCPPDYPIHPPRVKLMTTGNNTVRFNPNFYRNGKVCLSILGTWTGPAWSPAQSISSVLISIQSLMTENPYHNEPGFEQERHPGDSKNYNECIRHETIRVAVCDMMEGKCPCPEPLRGVMEKSFLEYYDFYEVACKDRLHLQGQTMQDPFGEKRGHFDYQSLLMRLGLIRQKVLERLHNENAEMDSDSSSSGTETDLHGSLRV

SEQ ID NO: 740 - protein, 559 aa, Human
MSATSVDTQRTKGQDNKVQNGSLHQKDTVHDNDFEPYLTGQSNQSNSYPSMSDPYLSSYYPPSIGFPYSLNEAPWSTAGDPPIPYLTTYGQLSNGDHHFMHDAVFGQPGGLGNNIYQHRFNFFPENPAFSAWGTSGSQGQQTQSSAYGSSYTYPPSSLGGTVVDGQPGFHSDTLSKAPGMNSLEQGMVGLKIGDVSSSAVKTVGSVVSSVALTGVLSGNGGTNVNMPVSKPTSWAAIASKPAKPQPKMKTKSGPVMGGGLPPPPIKHNMDIGTWDNKGPVPKAPVPQQAPSPQAAPQPQQVAQPLPAQPPALAQPQYQSPQQPPQTRWVAPRNRNAAFGQSGGAGSDSNSPGNVQPNSAPSVESHPVLEKLKAAHSYNPKEFEWNLKSGRVFIIKSYSEDDIHRSIKYSIWCSTEHGNKRLDSAFRCMSSKGPVYLLFSVNGSGHFCGVAEMKSPVDYGTSAGVWSQDKWKGKFDVQWIFVKDVPNNQLRHIRLENNDNKPVTNSRDTQEVPLEKAKQVLKIISSYKHTTSIFDDFAHYEKRQEEEEVVRKERQSRNKQ

SEQ ID NO: 741 - protein, 1048 aa, Human
MQSKVTGNMPTQSLLMYMDGPEVIGSSLGSPMEMEDALSMKGTAVVPFRATQEKNVIQIEGYMPLDCMFCSQTFTHSEDLNKHVLMQHRPTLCEPAVLRVEAEYLSPLDKSQVRTEPPKEKNCKENEFSCEVCGQTFRVAFDVEIHMRTHKDSFTYGCNMCGRRFKEPWFLKNHMRTHNGKSGARSKLQQGLESSPATINEVVQVHAAESISSPYKICMVCGFLFPNKESLIEHRKVHTKKTAFGTSSAQTDSPQGGMPSSREDFLQLFNLRPKSHPETGKKPVRCIPQLDPFTTFQAWQLATKGKVAICQEVKESGQEGSTDNDDSSSEKELGETNKGSCAGLSQEKEKCKHSHGEAPSVDADPKLPSSKEKPTHCSECGKAFRTYHQLVLHSRVHKKDRRAGAESPTMSVDGRQPGTCSPDLAAPLDENGAVDRGEGGSEDGSEDGLPEGIHLDKNDDGGKIKHLTSSRECSYCGKFFRSNYYLNIHLRTHTGEKPYKCEFCEYAAAQKTSLRYHLERHHKEKQTDVAAEVKNDGKNQDTEDALLTADSAQTKNLKRFFDGAKDVTGSPPAKQLKEMPSVFQNVLGSAVLSPAHKDTQDFHKNAADDSADKVNKNPTPAYLDLLKKRSAVETQANNLICRTKADVTPPPDGSTTHNLEVSPKEKQTETAADCRYRPSVDCHEKPLNLSVGALHNCPAISLSKSLIPSITCPFCTFKTFYPEVLMMHQRLEHKYNPDVHKNCRNKSLLRSRRTGCPPALLGKDVPPLSSFCKPKPKSAFPAQSKSLPSAKGKQSPPGPGKAPLTSGIDSSTLAPSNLKSHRPQQNVGVQGAATRQQQSEMFPKTSVSPAPDKTKRPETKLKPLPVAPSQPTLGSSNINGSIDYPAKNDSPWAPPGRDYFCNRSASNTAAEFGEPLPKRLKSSVVALDVDQPGANYRRGYDLPKYHMVRGITSLLPQDCVYPSQALPPKPRFLSSSEVDSPNVLTVQKPYGGSGPLYTCVPAGSPASSSTLEGKRPVSYQHLSNSMAQKRNYENFIGNAHYRPNDKKT

SEQ ID NO: 742 - protein, 113 aa, Human
MKPSPSQNRRSSDTGSKAPPTFKVSLMDQSVREGQDVIMSIRVQGEPKPVVSWLRNRQPVRPDQRRFAEEAEGGLCRLRILAAERGDAGFYTCKAVNEYGARQCEARLEVRGE

SEQ ID NO: 743 - protein, 471 aa, Human
MNYDSQQPPLPPLPYAGCRRASGFPALGRGGTVPVGVWGGAGQGREGRSWGEGPRGPGLGRRDLSSADPAVLGATMESRCYGCAVKFTLFKKEYGCKNCGRAFCSGCLSFSAAVPRTGNTQQKVCKQCHEVLTRGSSANASKWSPPQNYKKRVAALEAKQKPSTSQSQGLTRQDQMIAERLARLRQENKPKLVPSQAEIEARLAALKDERQGSIPSTQEMEARLAALQGRVLPSQTPQPAHHTPDTRTQAQQTQDLLTQLAAEVAIDESWKGGGPAASLQNDLNQGGPGSTNSKRQANWSLEEEKSRLLAEAALELREENTRQERILALAKRLAMLRGQDPERVTLQDYRLPDSDDDEDEETAIQRVLQQLTEEASLDEASGFNIPAEQASRPWTQPRGAEPEAQDVDPRPEAEEEELPWCCICNEDATLRCAGCDGDLFCARCFREGHDAFELKEHQTSAYSPPRAGQEH

SEQ ID NO: 744 - protein, 560 aa, Human
MAGPQPLALQLEQLLNPRPSEADPEADPEEATAARVIDRFDEGEDGEGDFLVVGSIRKLASASLLDTDKRYCGKTTSRKAWNEDHWEQTLPGSSDEEISDEEGSGDEDSEGLGLEEYDEDDLGAAEEQECGDHRESKKSRSHSAKTPGFSVQSISDFEKFTKGMDDLGSSEEEEDEESGMEEGDDAEDSQGESEEDRAGDRNSEDDGVVMTFSSVKVSEEVEKGRAVKNQIALWDQLLEGRIKLQKALLTTNQLPQPDVFPLFKDKGGPEFSSALKNSHKALKALLRSLVGLQEELLFQYPDTRYLVDGTKPNAGSEEISSEDDELVEEKKQQRRRVPAKRKLEMEDYPSFMAKRFADFTVYRNRTLQKWHDKTKLASGKLGKGFGAFERSILTQIDHILMDKERLLRRTQTKRSVYRVLGKPEPAAQPVPESLPGEPEILPQAPANAHLKDLDEEIFDDDDFYHQLLRELIERKTSSLDPNDQVAMGRQWLAIQKLRSKIHKKVDRKASKGRKLRFHVLSKLLSFMAPIDHTTMNDDARTELYRSLFGQLHPPDEGHGD

SEQ ID NO: 745 - protein, 475 aa, Human
MAELQMLLEEEIPGGRRALFDSYTNLERVADYCENNYIQSADKQRALEETKAYTTQSLASVAYLINTLANNVLQMLDIQASQLRRMESSINHISQTVDIHKEKVARREIGILTTNKNTSRTHKIIAPANLERPVRYIRKPIDYTILDDIGHGVKVSTQNMKMGGLPRTTPPTQKPPSPPMSGKGTLGRHSPYRTLEPVRPPVVPNDYVPSPTRNMAPSQQSPVRTASVNQRNRTYSSSGSSGGSHPSSRSSSRENSGSGSVGVPIAVPTPSPPSVFPGHPVQFYSMNRPASRHTPPTIGGSLPYRRPPSITSQTSLQNQMNGGPFYSQNPVSLAPPPPSILQVTPQLPLMGFVARVQENISDTPPPPPPVEEPVFDESPPPPPPPEDYEEEEAAVVEYSDPYAEEDPPWAPRSYLEKVVAIYDYTKDKEDELSFQEGAIIYVIKKNDDGWYEGVMNGVTGLFPGNYVESIMHYSE

SEQ ID NO: 746 - protein, 282 aa, Human
MASSFLPAGAITGDSGGELSSGDDSGEVEFPHSPEIEETSCLAELFEKAAAHLQGLIQVASREQLLYLYARYKQVKVGNCNTPKPSFFDFEGKQKWEAWKALGDSSPSQAMQEYIAVVKKLDPGWNPQIPEKKGKEANTGFGGPVISSLYHEETIREEDKNIFDYCRENNIDHITKAIKSKNVDVNVKDEEGRALLHWACDRGHKELVTVLLQHRADINCQDNEGQTALHYASACEFLDIVELLLQSGADPTLRDQDGCLPEEVTGCKTVSLVLQRHTTGKA

SEQ ID NO: 747 - protein, 330 aa, Human
MADIIARLREDGIQKRVIQEGRGELPDFQDGTKATFHYRTLHSDDEGTVLDDSRARGKPMELIIGKKFKLPVWETIVCTMREGEIAQFLCDIKHVVLYPLVAKSLRNIAVGKDPLEGQRHCCGVAQMREHSSLGHADLDALQQNPQPLIFHMEMLKVESPGTYQQDPWAMTDEEKAKAVPLIHQEGNRLYREGHVKEAAAKYYDAIACLKNLQMKEQPGSPEWIQLDQQITPLLLNYCQCKLVVEEYYEVLDHCSSILNKYDDNVKAYFKRGKAHAAVWNAQEAQADFAKVLELDPALAPVVSRELQALEARIRQKDEEDKARFRGIFSH

SEQ ID NO: 748 - protein, 1880 aa, Human
MPYSVGFREADAATSFLRAARSGNLDKALDHLRNGVDINTCNQNGLNGLHLASKEGHVKMVVELLHKEIILETTTKKGNTALHIAALAGQDEVVRELVNYGANVNAQSQKGFTPLYMAAQENHLEVVKFLLENGANQNVATEDGFTPLAVALQQGHENVVAHLINYGTKGKVRLPALHIAARNDDTRTAAVLLQNDPNPDVLSKTGFTPLHIAAHYENLNVAQLLLNRGASVNFTPQNGITPLHIASRRGNVIMVRLLLDRGAQIETKTKDELTPLHCAARNGHVRISEILLDHGAPIQAKTKNGLSPIHMAAQGDHLDCVRLLLQYDAEIDDITLDHLTPLHVAAHCGHHRVAKVLLDKGAKPNSRALNGFTPLHIACKKNHVRVMELLLKTGASIDAVTESGLTPLHVASFMGHLPIVKNLLQRGASPNVSNVKVETPLHMAARAGHTEVAKYLLQNKAKVNAKAKDDQTPLHCAARIGHTNMVKLLLENNANPNLATTAGHTPLHIAAREGHVETVLALLEKEASQACMTKKGFTPLHVAAKYGKVRVAELLLERDAHPNAAGKNGLTPLHVAVHHNNLDIVKLLLPRGGSPHSPAWNGYTPLHIAAKQNQVEVARSLLQYGGSANAESVQGVTPLHLAAQEGHAEMVALLLSKQANGNLGNKSGLTPLHLVAQEGHVPVADVLIKHGVMVDATTRMGYTPLHVASHYGNIKLVKFLLQHQADVNAKTKLGYSPLHQAAQQGHTDIVTLLLKNGASPNEVSSDGTTPLAIAKRLGYISVTDVLKVVTDETSFVLVSDKHRMSFPETVDEILDVSEDEGEELISFKAERRDSRDVDEEKELLDFVPKLDQVVESPAIPRIPCAMPETVVIRSEEQEQASKEYDEDSLIPSSPATETSDNISPVASPVHTGFLVSFMVDARGGSMRGSRHNGLRVVIPPRTCAAPTRITCRLVKPQKLSTPPPLAEEEGLASRIIALGPTGAQFLSPVIVEIPHFASHGRGDRELVVLRSENGSVWKEHRSRYGESYLDQILNGMDEELGSLEELEKKRVCRIITTDFPLYFVIMSRLCQDYDTIGPEGGSLKSKLVPLVQATFPENAVTKRVKLALQAQPVPDELVTKLLGNQATFSPIVTVEPRRRKFHRPIGLRIPLPPSWTDNPRDSGEGDTTSLRLLCSVIGGTDQAQWEDITGTTKLVYANECANFTTNVSARFWLSDCPRTAEAVNFATLLYKELTAVPYMAKFVIFAKMNDPREGRLRCYCMTDDKVDKTLEQHENFVEVARSRDIEVLEGMSLFAELSGNLVPVKKAAQQRSFHFQSFRENRLAMPVKVRDSSREPGGSLSFLRKAMKYEDTQHILCHLNITMPPCAKGSGAEDRRRTPTPLALRYSILSESTPGSLSGTEQAEMKMAVISEHLGLSWAELARELQFSVEDINRIRVENPNSLLEQSVALLNLWVIREGQNANMENLYTALQSIDRGEIVNMLEGSGRQSRNLKPDRRHTDRDYSLSPSQMNGYSSLQDELLSPASLGCALSSPLRADQYWNEVAVLDAIPLAATEHDTMLEMSDMQVWSAGLTPSLVTAEDSSLECSKAEDSDATGHEWKLEGALSEEPRGPELGSLELVEDDTVDSDATNGLIDLLEQEEGQRSEEKLPGSKRQDDATGAGQDSENEVSLVSGHQRGQARITHSPTVSQVTERSQDRLQDWDADGSIVSYLQDAAQGSWQEEVTQGPHSFQGTSTMTEGLEPGGSQEYEKVLVSVSEHTWTEQPEAESSQADRDRRQQGQEEQVQEAKNTFTQVVQGNEFQNIPGEQVTEEQFTDEQGNIVTKKIIRKVVRQIDLSSADAAQEHEEVELRGSGLQPDLIEGRKGAQIVKRASLKRGKQ

SEQ ID NO: 749 - protein, 204 aa, Human
MAEQEPTAEQLAQIAAENEEDEHSVNYKPPAQKSIQEIQELDKDDESLRKYKEALLGRVAVSADPNVPNVVVTGLTLVCSSAPGPLELDLTGDLESFKKQSFVLKEGVEYRIKISFRVNREIVSGMKYIQHTYRKGVKIDKTDYMVGSYGPRAEEYEFLTPVEEAPKGMLARGSYSIKSRFTDDDKTDHLSWEWNLTIKKDWKD

SEQ ID NO: 750 - protein, 448 aa, Human
MKGFIDDANYSVGLLDEGTNLGNVIDNYVYEHTLTGKNAFFVGDLGKIVKKHSQWQNVVAQIKPFYTVKCNSAPAVLEILAALGTGFACSSKNEMALVQELGVPPENIIYISPCKQVSQIKYAAKVGVNILTCDNEIELKKIARNHPNAKVLLHIATEDNIGGEEGNMKFGTTLKNCRHLLECAKELDVQIIGVKFHVSSACKESQVYVHALSDARCVFDMAGEIGFTMNMLDIGGGFTGTEFQLEEVNHVISPLLDIYFPEGSGVKIISEPGSYYVSSAFTLAVNIIAKKVVENDKFPSGVEKTGSDEPAFMYYMNDGVYGSFASKLSEDLNTIPEVHKKYKEDEPLFTSSLWGPSCDELDQIVESCLLPELNVGDWLIFDNMGADSFHEPSAFNDFQRPAIYYMMSFSDWYEMQDAGITSDSMMKNFFFVPSCIQLSQEDSFSAEA

SEQ ID NO: 751 - protein, 293 aa, Human
MRVDSSADPTMSQEQGPGSSTPPSSPTLLDALLQNLYDFGGTEGETEQKKIIKKRENKKRDVMASAALAAEPSPLPGSLIRGQRKSASSFFKELREERHCAPSGTPTGPEILAAAVPPSSLKNNREQVEVVEFHSNKKRKLTPDHNKNTKQANPSVLERDVDTQEFNLEKARLEVHRFGITGYGKGKERILEQERAIMLGAKPPKKSYVNYKVLQEQIKEKKAAKEEEKRLAQETDIFKKKKRKGQEDRKSKKKSAPSILSNGRIGQVGKFKNGTLILSPVDIKKINSSRVAK

SEQ ID NO: 752 - protein, 83 aa, Human
MSGPNGDLGMPVEAGAEGEEDGFGEAEYAAINSMLDQINSCLDHLEEKNDHLHARLQELLESNRQTRLEFQQQLGEAPSDASP

SEQ ID NO: 753 - protein, 183 aa, Human
MASNKTTLQKMGKKQNGKSKKVEEAEPEEFVVEKVLDRRVVNGKVEYFLKWKGFTDADNTWEPEENLDCPELIEAFLNSQKAGKEKDGTKRKSLSDSESDDSKSKKKRDAADKPRGFARGLDPERIIGATDSSGELMFLMKWKDSDEADLVLAKEANMKCPQIVIAFYEERLTWHSCPEDEAQ

SEQ ID NO: 754 - protein, 550 aa, Human
MSHGPSPRLAESPQLSKGSLLTILGSPSPERMGPADSLPPTPPSGTPSPGPPPALPLPPAPALLADGDWESREELRLRELEEARARAAQMEKTMRRWSDCTANWREKWSKVRAERNRAREEVRQLRQRLDALTKELAGARRERQEAQGECEARGRELARLRGARGVADQTRDGPEPEAEREPVRDVGSERPPGSQELELVESLLKSMPEESEDCWEARSLGAGGPRGSSGRQERSRLPWEDTAATEEEASKLTALRLRLDESQKVLLKEREDKLALSRNIEKLEGELSQWKIKYEELSKTKQEMLKQLSILKEAHQDELGRMSEDLEDELGARSSMDRKMAELRGEMERLQAENAAEWGRRERLETEKLGLERENKKLRAQVGDLEEALARRRRQTASALDCDLRASQAALFEKNKELADLKHVHGKLKKQFQEKVAELAHANRRVEQHEAEVKKLRLRVEELKKELAQAEDELDEAHNQARKLQRSLDEQTEQSENLQVQLEHLQSRLRRQQQNAPLFGKIRSARFGTEEAEDGTSDLDEDEDLQIQVA

SEQ ID NO: 755 - protein, 360 aa, Human
MASATAPAAAVPTLASPLEQLRHLAEELRLLLPRVRVGEAQETTEEFNREMFWRRLNEAAVTVSREATTLTIVFSQLPLPSPQETQKFCEQVHAAIKAFIAVYYLLPKDQGITLRKLVRGATLDIVDGMAQLMEVLSVTPTQSPENNDLISYNSVWVACQQMPQIPRDNKAAALLMLTKNVDFVKDAHEEMEQAVEECDPYSGLLNDTEENNSDNHNHEDDVLGFPSNQDLYWSEDDQELIIPCLALVRASKACLKKIRMLVAENGKKDQVAQLDDIVDISDEISPSVDDLALSIYPPMCHLTVRINSAKLVSVLKKALEITKASHVTPQPEDSWIPLLINAIDHCMNRIKELTQSELEL

SEQ ID NO: 756 - protein, 247 aa, Human
MEEQPQMQDADEPADSGGEGRAGGPPQVAGAQAACSEDRMTLLLRLRAQTKQQLLEYKSMVDASEEKTPEQIMQEKQIEAKIEDLENEIEEVKVAFEIKKLALDRMRLSTALKKNLEKISRQSSVLMDNMKHLLELNKLIMKSQQESWDLEEKLLDIRKKRLQLKQASESKLLEIQTEKNKQKIDLDSMENSERIKIIRQNLQMEIKITTVIQHVFQNLILGSKVNWAEDPALKEIVLQLEKNVDMM

SEQ ID NO: 757 - protein, 907 aa, Human
MNRFRVSKFRHTEARPPRRESWISDIRAGTAPSCRNHIKSSCSLIAFNSDRPGVLGIVPLQGQGEDKRRVAHLGCHSGSADRTVKLWRLPGPGQALPSAPGVVLGPEDLPVEVLQFHPTSDGILVSAAGTTVKVWDAAKQQPLTELAAHGDLVQSAVWSRDGALVGTACKDKQLRIFDPRTKPRASQSTQAHENSRDSRLAWMGTWEHLVSTGFNQMREREVKLWDTRFFSSALASLTLDTSLGCLVPLLDPDSGLLVLAGKGERQLYCYEVVPQQPALSPVTQCVLESVLRGAALVPRQALAVMSCEVLRVLQLSDTAIVPIGYHVPRKAVEFHEDLFPDTAGCVPATDPHSWWAGDNQQVQKVSLNPACRPHPSFTSCLVPPAEPLPDTAQPAVMETPVGDADASEGFSSPPSSLTSPSTPSSLGPSLSSTSGIGTSPSLRSLQSLLGPSSKFRHAQGTVLHRDSHITNLKGLNLTTPGESDGFCANKLRVAVPLLSSGGQVAVLELRKPGRLPDTALPTLQNGAAVTDLAWDPFDPHRLAVAGEDARIRLWRVPAEGLEEVLTTPETVLTGHTEKICSLRFHPLAANVLASSSYDLTVRIWDLQAGADRLKLQGHQDQIFSLAWSPDGQQLATVCKDGRVRVYRPRSGPEPLQEGPGPKGGRGARIVWVCDGRCLLVSGFDSQSERQLLLYEAEALAGGPLAVLGLDVAPSTLLPSYDPDTGLVLLTGKGDTRVFLYELLPESPFFLECNSFTSPDPHKGLVLLPKTECDVREVELMRCLRLRQSSLEPVAFRLPRVRKEFFQDDVFPDTAVIWEPVLSAEAWLQGANGQPWLLSLQPPDMSPVSQAPREAPARRAPSSAQYLEEKSDQQKKEELLNAMVAKLGNREDPLPQDSFEGVDEDEWD

SEQ ID NO: 758 - protein, 740 aa, Human
MAAFSEMGVMPEIAQAVEEMDWLLPTDIQAESIPLILGGGDVLMAAETGSGKTGAFSIPVIQIVYETLKDQQEGKKGKTTIKTGASVLNKWQMNPYDRGSAFAIGSDGLCCQSREVKEWHGCRATKGLMKGKHYYEVSCHDQGLCRVGWSTMQASLDLGTDKFGFGFGGTGKKSHNKQFDNYGEEFTMHDTIGCYLDIDKGHVKFSKNGKDLGLAFEIPPHMKNQALFPACVLKNAELKFNFGEEEFKFPPKDGFVALSKAPDGYIVKSQHSGNAQVTQTKFLPNAPKALIVEPSRELAEQTLNNIKQFKKYIDNPKLRELLIIGGVAARDQLSVLENGVDIVVGTPGRLDDLVSTGKLNLSQVRFLVLDEADGLLSQGYSDFINRMHNQIPQVTSDGKRLQVIVCSATLHSFDVKKLSEKIMHFPTWVDLKGEDSVPDTVHHVVVPVNPKTDRLWERLGKSHIRTDDVHAKDNTRPGANSPEMWSEAIKILKGEYAVRAIKEHKMDQAIIFCRTKIDCDNLEQYFIQQGGGPDKKGHQFSCVCLHGDRKPHERKQNLERFKKGDVRFLICTDVAARGIDIHGVPYVINVTLPDEKQNYVHRIGRVGRAERMGLAISLVATEKEKVWYHVCSSRGKGCYNTRLKEDGGCTIWYNEMQLLSEIEEHLNCTISQVEPDIKVPVDEFDGKVTYGQKRAAGGGSYKGHVDILAPTVQELAALEKEAQTSFLHLGYLPNQLFRTF

SEQ ID NO: 759 - protein, 619 aa, Human
MLLASAVVVWEWLNEHGRWRPYSPAVSHHIEAVVRAGPRAGGSVVLGQVDSRLAPYIIDLQSMNQFRQDTGTLRPVRRNYYDPSSAPGKGVVWEWENDNGSWTPYDMEVGITIQHAYEKQHPWIDLTSIGFSYVIDFNTMGQINRQTQRQRRVRRRLDLIYPMVTGTLPKAQSWPVSPGPATSPPMSPCSCPQCVLVMSVKAAVVNGSTGPLQLPVTRKNMPPPGVVKLPPLPGSGAKPLDSTGTIRGPLKTAPSQVIRRQASSMPTGTTMGSPASPPGPNSKTGRVALATLNRTNLQRLAIAQSRVLIASGVPTVPVKNLNGSSPVNPALAGITGILMSAAGLPVCLTRPPKLVLHPPPVSKSEIKSIPGVSNTSRKTTKKQAKKGKTPEEVLKKYLQKVRHPPDEDCTICMERLTAPSGYKGPQPTVKPDLVGKLSRCGHVYHIYCLVAMYNNGNKDGSLQCPTCKTIYGVKTGTQPPGKMEYHLIPHSLPGHPDCKTIRIIYSIPPGIQGPEHPNPGKSFSARGFPRHCYLPDSEKGRKVLKLLLVAWDRRLIFAIGTSSTTGESDTVIWNEVHHKTEFGSNLTGHGYPDANYLDNVLAELAAQGISEDSTAQEKD

SEQ ID NO: 760 - protein, 523 aa, Human
MAAVGRVGSFGSSPPGLSSTYTGGPLGNEIASGNGGAAAGDDEDGQNLWSCILSEVSTRSRSKLPAGKNVLLLGEDGAGKTSLIRKIQGIEEYKKGRGLEYLYLNVHDEDRDDQTRCNVWILDGDLYHKGLLKFSLDAVSLKDTLVMLVVDMSKPWTALDSLQKWASVVREHVDKLKIPPEEMKQMEQKLIRDFQEYVEPGEDFPASPQRRNTASQEDKDDSVVLPLGADTLTHNLGIPVLVVCTKCDAISVLEKEHDYRDEHFDFIQSHIRKFCLQYGAALIYTSVKENKNIDLVYKYIVQKLYGFPYKIPAVVVEKDAVFIPAGWDNDKKIGILHENFQTLKAEDNFEDIITKPPVRKFVHEKEIMAEDDQVFLMKLQSLLAKQPPTAAGRPVDASPRVPGGSPRTPNRSVSSNVASVSPIPAGSKKIDPNMKAGATSEGVLANFFNSLLSKKTGSPGGPGVSGGSPAGGAGGGSSGLPPSTKKSGQKPVLDVHAELDRITRKPVTVSPTTPTSPTEGEAS

SEQ ID NO: 761 - protein, 237 aa, Human
MLDLTSRGQVGTSRRMAEAACSAHFLETTPTPNPPTTEEEKTESNQEVANPEHYIKHPLQNRWALWFFKNDKSKTWQANLRLISKFDTVEDFWALYNHIQLSSNLMPGCDYSLFKDGIEPMWEDEKNKRGGRWLITLNKQQRRSDLDRFWLETLLCLIGESFDDYSDDVCGAVVNVRAKGDKIAIWTTECENREAVTHIGRVYKERLGLPPKIVIGYQSHADTATKSGSTTKNRFVV

SEQ ID NO: 762 - protein, 896 aa, Human
MDGAAGPGDGPAREALQSLSQRLRVQEQEMELVKAALAEALRLLRLQVPPSSLQGSGTPAPPGDSLAAPPGLPPTCTPSLVSRGTQTETEVELKSSPGPPGLSNGPPAPQGASEEPSGTQSEGGGSSSSGAGSPGPPGILRPLQPPQRADTPRRNSSSSSSPSERPRQKLSRKAISSANLLVRSGSTESRGGKDPLSSPGGPGSRRSNYNLEGISVKMFLRGRPITMYIPSGIRSLEELPSGPPPETLSLDWVYGYRGRDSRSNLFVLRSGEVVYFIACVVVLYRPGGGPGGPGGGGQRHYRGHTDCVRCLAVHPDGVRVASGQTAGVDKDGKPLQPVVHIWDSETLLKLQEIGLGAFERGVGALAFSAADQGAFLCVVDDSNEHMLSVWDCSRGMKLAEIKSTNDSVLAVGFNPRDSSCIVTSGKSHVHFWNWSGGVGVPGNGTLTRKQGVFGKYKKPKFIPCFVFLPDGDILTGDSEGNILTWGRSPSDSKTPGRGGAKETYGIVAQAHAHEGSIFALCLRRDGTVLSGGGRDRRLVQWGPGLVALQEAEIPEHFGAVRAIAEGLGSELLVGTTKNALLRGDLAQGFSPVIQGHTDELWGLCTHPSQNRFLTCGHDRQLCLWDGESHALAWSIDLKETGLCADFHPSGAVVAVGLNTGRWLVLDTETREIVSDVIDGNEQLSVVRYSPDGLYLAIGSHDNVIYIYSVSSDGAKSSRFGRCMGHSSFITHLDWSKDGNFIMSNSGDYEILYWDVAGGCKQLKNRYESRDREWATYTCVLGFHVYGVWPDGSDGTDINSLCRSHNERVVAVADDFCKVHLFQYPCARAKAPSRMYGGHGSHVTSVRFTHDDSHLVSLGGKDASIFQWRVLGAGGAGPAPATPSRTPSLSPASSLDV

SEQ ID NO: 763 - protein, 591 aa, Human
MSEQSICQARAAVMVYDDANKKWVPAGGSTGFSRVHIYHHTGNNTFRVVGRKIQDHQVVINCAIPKGLKYNQATQTFHQWRDARQVYGLNFGSKEDANVFASAMMHALEVLNSQETGPTLPRQNSQLPAQVQNGPSQEELEIQRRQLQEQQRQKELERERLERERMERERLERERLERERLERERLEQEQLERERQERERQERLERQERLERQERLERQERLDRERQERQERERLERLERERQERERQEQLEREQLEWERERRISSAAAPASVETPLNSVLGDSSASEPGLQAASQPAETPSQQGIVLGPLAPPPPPPLPPGPAQASVALPPPPGPPPPPPLPSTGPPPPPPPPPLPNQVPPPPPPPPAPPLPASGFFLASMSEDNRPLTGLAAAIAGAKLRKVSRMEDTSFPSGGNAIGVNSASSKTDTGRGNGPLPLGGSGLMEEMSALLARRRRIAEKGSTIETEQKEDKGEDSEPVTSKASSTSTPEPTRKPWERTNTMNGSKSPVISRRDSPRKNQIVFDNRSYDSLHRPKSTPLSQPSANGVQTEGLDYDRLKQDILDEMRKELTKLKEELIDAIRQELSKSNTA

SEQ ID NO: 764 - protein, 686 aa, Human
MQLGEQLLVSSVNLPGAHFYPLESARGGSGGSAGHLPSAAPSPQKLDLDKASKKFSGSLSCEAVSGEPAAASAGAPAAMLSDTDAGDAFASAAAVAKPGPPDGRKGSPCGEEELPSAAAAAAAAAAAAAATARYSMDSLSSERYYLQSPGPQGSELAAPCSLFPYQAAAGAPHGPVYPAPNGARYPYGSMLPPGGFPAAVCPPGRAQFGPGAGAGSGAGGSSGGGGGPGTYQYSQGAPLYGPYPGAAAAGSCGGLGGLGVPGSGFRAHVYLCNRPLWLKFHRHQTEMIITKQGRRMFPFLSFNINGLNPTAHYNVFVEVVLADPNHWRFQGGKWVTCGKADNNMQGNKMYVHPESPNTGSHWMRQEISFGKLKLTNNKGANNNNTQMIVLQSLHKYQPRLHIVEVTEDGVEDLNEPSKTQTFTFSETQFIAVTAYQNTDITQLKIDHNPFAKGFRDNYDSSHQIVPGGRYGVQSFFPEPFVNTLPQARYYNGERTVPQTNGLLSPQQSEEVANPPQRWLVTPVQQPGTNKLDISSYESEYTSSTLLPYGIKSLPLQTSHALGYYPDPTFPAMAGWGGRGSYQRKMAAGLPWTSRTSPTVFSEDQLSKEKVKEEIGSSWIETPPSIKSLDSNDSGVYTSACKRRRLSPSNSSNENSPSIKCEDINAEEYSKDTSKGMGGYYAFYTTP

SEQ ID NO: 765 - protein, 339 aa, Human
MAQYKGAASEAGRAMHLMKKREKQREQMEQMKQRIAEENIMKSNIDKKFSAHYDAVEAELKSSTVGLVTLNDMKAKQEALVKEREKQLAKKEQSKELQMKLEKLREKERKKEAKRKISSLSFTLEEEEEGGEEEEEAAMYEEEMEREEITTKKRKLGKNPDVDTSFLPDRDREEEENRLREELRQEWEAKQEKIKSEEIEITFSYWDGSGHRRTVKMRKGNTMQQFLQKALEILRKDFSELRSAGVEQLMYIKEDLIIPHHHSFYDFIVTKARGKSGPLFNFDVHDDVRLLSDATVEKDESHAGKVVLRSWYEKNKHIFPASRWEPYDPEKKWDKYTIR

SEQ ID NO: 766 - protein, 690 aa, Human
MQPPPRKVKPAQEVKLRFLEQLSILQTWQQREADLLEDIRSYSKQRAAIEREYGQALQKLAGPFLKREGHRSGEMDSRGRTVFGAWRCLLDATVAGGQTRLQASDRYRDLAGGTGRSAKEQVLRKGTENLQRAQAEVLQSVRELSRSRKLYGQRERVWALAQEKAADVQARLNRSDHGIFHSRTSLQKLSTKLSAQSAQYSQQLQAARNEYLLNLVATNAHLDHYYQEELPALLKALVSELSEHLRDPLTSLSHTELEAAEVILEHAHRGEQTTSQVSWEQDLKLFLQEPGVFSPTPPQQFQPAGTDQVCVLEWGAEGVAGKSGLEKEVQRLTSRAARDYKIQNHGHRVLQRLEQRRQQASEREAPSIEQRLQEVRESIRRAQVSQVKGAARLALLQGAGLDVERWLKPAMTQAQDEVEQERRLSEARLSQRDLSPTAEDAELSDFEECEETGELFEEPAPQALATRALPCPAHVVFRYQAGREDELTITEGEWLEVIEEGDADEWVKARNQHGEVGFVPERYLNFPDLSLPESSQDSDNPCGAEPTAFLAQALYSYTGQSAEELSFPEGALIRLLPRAQDGVDDGFWRGEFGGRVGVFPSLLVEELLGPPGPPELSDPEQMLPSPSPPSFSPPAPTSVLDGPPAPVLPGDKALDFPGFLDMMAPRLRPMRPPPPPPAKAPDPGHPDPLT

SEQ ID NO: 767 - protein, 694 aa, Human
MSGGEVVCSGWLRKSPPEKKLKRYAWKRRWFVLRSGRLTGDPDVLEYYKNDHAKKPIRIIDLNLCQQVDAGLTFNKKEFENSYIFDINTIDRIFYLVADSEEEMNKWVRCICDICGFNPTEEDPVKPPGSSLQAPADLPLAINTAPPSTQADSSSATLPPPYQLINVPPHLETLGIQEDPQDYLLLINCQSKKPEPTRTHADSAKSTSSETDCNDNVPSHKNPASSQSKHGMNGFFQQQMIYDSPPSRAPSASVDSSLYNLPRSYSHDVLPKVSPSSTEADGELYVFNTPSGTSSVETQMRHVSISYDIPPTPGNTYQIPRTFPEGTLGQTSKLDTIPDIPPPRPPKPHPAHDRSPVETCSIPRTASDTDSSYCIPTAGMSPSRSNTISTVDLNKLRKDASSQDCYDIPRAFPSDRSSSLEGFHNHFKVKNVLTVGSVSSEELDENYVPMNPNSPPRQHSSSFTEPIQEANYVPMTPGTFDFSSFGMQVPPPAHMGFRSSPKTPPRRPVPVADCEPPPVDRNLKPDRKVKPAPLEIKPLPEWEELQAPVRSPITRSFARDSSRFPMSPRPDSVHSTTSSSDSHDSEENYVPMNPNLSSEDPNLFGSNSLDGGSSPMIKPKGDKQVEYLDLDLDSGKSTPPRKQKSSGSGSSVADERVDYVVVDQQKTLALKSTREAWTDGRQSTESETPAKSVK

SEQ ID NO: 768 - protein, 173 aa, Human
MALRVVRSVRALLCTLRAVPSPAAPCPPRPWQLGVGAVRTLRTGPALLSVRKFTEKHEWVTTENGIGTVGISNFAQEALGDVVYCSLPEVGTKLNKQDEFGALESVKAASELYSPLSGEVTEINEALAENPGLVNKSCYEDGWLIKMTLSNPSELDELMSEEAYEKYIKSIEE

SEQ ID NO: 769 - protein, 333 aa, Human
MPLGLGRRKKAPPLVENEEAEPGRGGLGVGEPGPLGGGGSGGPQMGLPPPPPALRPRLVFHTQLAHGSPTGRIEGFTNVKELYGKIAEAFRLPTAEVMFCTLNTHKVDMDKLLGGQIGLEDFIFAHVKGQRKEVEVFKSEDALGLTITDNGAGYAFIKRIKEGSVIDHIHLISVGDMIEAINGQSLLGCRHYEVARLLKELPRGRTFTLKLTEPRKAFDMISQRSAGGRPGSGPQLGTGRGTLRLRSRGPATVEDLPSAFEEKAIEKVDDLLESYMGIRDTELAATMVELGKDKRNPDELAEALDERLGDFAFPDEFVFDVWGAIGDAKVGRY

SEQ ID NO: 770 - protein, 770 aa, Human
MSRKGPRAEVCADCSAPDPGWASISRGVLVCDECCSVHRSLGRHISIVKHLRHSAWPPTLLQMVHTLASNGANSIWEHSLLDPAQVQSGRRKANPQDKVHPIKSEFIRAKYQMLAFVHKLPCRDDDGVTAKDLSKQLHSSVRTGNLETCLRLLSLGAQANFFHPEKGTTPLHVAAKAGQTLQAELLVVYGADPGSPDVNGRTPIDYARQAGHHELAERLVECQYELTDRLAFYLCGRKPDHKNGHYIIPQMADRSRQKCMSQSLDLSELAKAAKKKLQALSNRLFEELAMDVYDEVDRRENDAVWLATQNHSTLVTERSAVPFLPVNPEYSATRNQGRQKLARFNAREFATLIIDILSEAKRRQQGKSLSSPTDNLELSLRSQSDLDDQHDYDSVASDEDTDQEPLRSTGATRSNRARSMDSSDLSDGAVTLQEYLELKKALATSEAKVQQLMKVNSSLSDELRRLQREIHKLQAENLQLRQPPGPVPTPPLPSERAEHTPMAPGGSTHRRDRQAFSMYEPGSALKPFGGPPGDELTTRLQPFHSTELEDDAIYSVHVPAGLYRIRKGVSASAVPFTPSSPLLSCSQEGSRHTSKLSRHGSGADSDYENTQSGDPLLGLEGKRFLELGKEEDFHPELESLDGDLDPGLPSTEDVILKTEQVTKNIQELLRAAQEFKHDSFVPCSEKIHLAVTEMASLFPKRPALEPVRSSLRLLNASAYRLQSECRKTVPPEPGAPVDFQLLTQQVIQCAYDIAKAAKQLVTITTREKKQ

SEQ ID NO: 771 - protein, 465 aa, Human
MAQHDFAPAWLNFPTPPSSTKVLTSSLKSSLNFEKHSENFAWTENRYDVNRRRHNSSDGFDSAIGRPNGGNFGRKEKNGWRTHGRNGTENINHRGGYHGGSSRSRSSIFHAGKSQGLHENNIPDNETGRKEDKRERKQFEAEDFPSLNPEYEREPNHNKSLAAGVWEYPPNPKSRAPRMLVIKKGNTKDLQLSGFPVVGNLPSQPVKNGTGPSVYKGLVPKPAAPPTKPTQWKSQTKENKVGTSFPHESTFGVGNFNAFKSTAKNFSPSTNSVKEQPRLTKLTRMRTDKKSEFLKALKRDRVEEEHEDESRAGSEKDDDSFNLHNSNSTHQERDINRNFDENEIPQENGNASVISQQIIRSSTFPQTDVLSSSLEAEHRLLKEMGWQEDSENDETCAPLTEDEMREFQVISEQLQKNGLRKNGILKNGLICDFKFGPWKNSTFKPTTENDDTETSSSDTSDDDDV

SEQ ID NO: 772 - protein, 517 aa, Human
MAALGPSSQNVTEYVVRVPKNTTKKYNIMAFNAADKVNFATWNQARLERDLSNKKIYQEEEMPESGAGSEFNRKLREEARRKKYGIVLKEFRPEDQPWLLRVNGKSGRKFKGIKKGGVTENTSYYIFTQCPDGAFEAFPVHNWYNFTPLARHRTLTAEEAEEEWERRNKVLNHFSIMQQRRLKDQDQDEDEEEKEKRGRRKASELRIHDLEDDLEMSSDASDASGEEGGRVPKAKKKAPLAKGGRKKKKKKGSDDEAFEDSDDGDFEGQEVDYMSDGSSSSQEEPESKAKAPQQEEGPKGVDEQSDSSEESEEEKPPEEDKEEEEEKKAPTPQEKKRRKDSSEESDSSEESDIDSEASSALFMAKKKTPPKRERKPSGGSSRGNSRPGTPSAEGGSTSSTLRAAASKLEQGKRVSEMPAAKRLRLDTGPQSLSGKSTPQPPSGKTTPNSGDVQVTEDAVRRYLTRKPMTTKDLLKKFQTKKTGLSSEQTVNVLAQILKRLNPERKMINDKMHFSLKE

SEQ ID NO: 773 - protein, 215 aa, Human
MSETVPPAPAASAAPEKPLAGKKAKKPAKAAAASKKKPAGPSVSELIVQAASSSKERGGVSLAALKKALAAAGYDVEKNNSRIKLGIKSLVSKGTLVQTKGTGASGSFKLNKKASSVETKPGASKVATKTKATGASKKLKKATGASKKSVKTPKKAKKPAATRKSSKNPKKPKTVKPKKVAKSPAKAKAVKPKAAKARVTKPKTAKPKKAAPKKK

SEQ ID NO: 774 - protein, 754 aa, Human
MFSGGCHSPGFGRPSPAFPAPGSPPPAPRPCRQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGSLCTSFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 775 - protein, 307 aa, Human
MARNAEKAMTALARFRQAQLEEGKVKERRPFLASECTELPKAEKWRRQIIGEISKKVAQIQNAGLGEFRIRDLNDEINKLLREKGHWEVRIKELGGPDYGKVGPKMLDHEGKEVPGNRGYKYFGAAKDLPGVRELFEKERQVRWLMPVIPALWEAEAGGSQALPPPRKTRAELMKAIDFEYYGYLDEDDGVIVPLEQEYEKKLRAELVEKWKAEREARLARGEKEEEEEEEEEINIYAVTEEESDEEGSQEKGGDDSQQKFIAHVPVPSQQEIEEALVRRKKMELLQKYASETLQAQSEEARRLLGY

SEQ ID NO: 776 - protein, 1356 aa, Human
MQSKVLLAVALWLCVETRAASVGLPSVSLDLPRLSIQKDILTIKANTTLQITCRGQRDLDWLWPNNQSGSEQRVEVTECSDGLFCKTLTIPKVIGNDTGAYKCFYRETDLASVIYVYVQDYRSPFIASVSDQHGVVYITENKNKTVVIPCLGSISNLNVSLCARYPEKRFVPDGNRISWDSKKGFTIPSYMISYAGMVFCEAKINDESYQSIMYIVVVVGYRIYDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKPFVAFGSGMESLVEATVGERVRIPAKYLGYPPPEIKWYKNGIPLESNHTIKAGHVLTIMEVSERDTGNYTVILTNPISKEKQSHVVSLVVYVPPQIGEKSLISPVDSYQYGTTQTLTCTVYAIPPPHHIHWYWQLEEECANEPSQAVSVTNPYPCEEWRSVEDFQGGNKIEVNKNQFALIEGKNKTVSTLVIQAANVSALYKCEAVNKVGRGERVISFHVTRGPEITLQPDMQPTEQESVSLWCTADRSTFENLTWYKLGPQPLPIHVGELPTPVCKNLDTLWKLNATMFSNSTNDILIMELKNASLQDQGDYVCLAQDRKTKKRHCVVRQLTVLERVAPTITGNLENQTTSIGESIEVSCTASGNPPPQIMWFKDNETLVEDSGIVLKDGNRNLTIRRVRKEDEGLYTCQACSVLGCAKVEAFFIIEGAQEKTNLEIIILVGTAVIAMFFWLLLVIILRTVKRANGGELKTGYLSIVMDPDELPLDEHCERLPYDASKWEFPRDRLKLGKPLGRGAFGQVIEADAFGIDKTATCRTVAVKMLKEGATHSEHRALMSELKILIHIGHHLNVVNLLGACTKPGGPLMVIVEFCKFGNLSTYLRSKRNEFVPYKTKGARFRQGKDYVGAIPVDLKRRLDSITSSQSSASSGFVEEKSLSDVEEEEAPEDLYKDFLTLEHLICYSFQVAKGMEFLASRKCIHRDLAARNILLSEKNVVKICDFGLARDIYKDPDYVRKGDARLPLKWMAPETIFDRVYTIQSDVWSFGVLLWEIFSLGASPYPGVKIDEEFCRRLKEGTRMRAPDYTTPEMYQTMLDCWHGEPSQRPTFSELVEHLGNLLQANAQQDGKDYIVLPISETLSMEEDSGLSLPTSPVSCMEEEEVCDPKFHYDNTAGISQYLQNSKRKSRPVSVKTFEDIPLEEPEVKVIPDDNQTDSGMVLASEELKTLEDRTKLSPSFGGMVPSKSRESVASEGSNQTSGYQSGYHSDDTDTTVYSSEEAELLKLIEIGVQTGSTAQILQPDSGTTLSSPPV

SEQ ID NO: 777 - protein, 714 aa, Human
MSIALGNTYRRSLSDSETVSVLQASLCEEKKEKSSKPKDPPPFEGMEIDEVANINDMDEYIELLYEDIPDKVRGSALILQLARNPDNLEELLLNETALGALARVLREDWKQSVELATNIIYIFFCFSSFSQFHGLITHYKIGALCMNIIDHELKRHELWQEELSKKKKAVDEDPENQTLRKDYEKTFKKYQGLVVKQEQLLRVALYLLLNLAEDTRTELKMRNKNIVHMLVKALDRDNFELLILVVSFLKKLSIFMENKNDMVEMDIVEKLVKMIPCEHEDLLNITLRLLLNLSFDTGLRNKMVQVGLLPKLTALLGNDNYKQIAMCVLYHISMDDRFKSMFAYTDCIPQLMKMLFECSDERIDLELISFCINLAANKRNVQLICEGNGLKMLMKRALKFKDPLLMKMIRNISQHDGPTKNLFIDYVGDLAAQISNDEEEEFVIECLGTLANLTIPDLDWELVLKEYKLVPYLKDKLKPGAAEDDLVLEVVIMIGTVSMDDSCAALLAKSGIIPALIELLNAQQEDDEFVCQIIYVFYQMVFHQATRDVIIKETQAPAYLIDLMHDKNNEIRKVCDNTLDIIAEYDEEWAKKIQSEKFRWHNSQWLEMVESRQMDESEQYLYGDDRIEPYIHEGDILERPDLFYNSDGLIASEGAISPDFFNDYHLQNGDVVGQHSFPGSLGMDGFGQPVGILGRPATAYGFRPDEPYYYGYGS

SEQ ID NO: 778 - protein, 776 aa, Human
MAEPRQEFEVMEDHAGTYGLGDRKDQGGYTMHQDQEGDTDAGLKESPLQTPTEDGSEEPGSETSDAKSTPTAEDVTAPLVDEGAPGKQAAAQPHTEIPEGTTAEEAGIGDTPSLEDEAAGHVTQEPESGKVVQEGFLREPGPPGLSHQLMSGMPGAPLLPEGPREATRQPSGTGPEDTEGGRHAPELLKHQLLGDLHQEGPPLKGAGGKERPGSKEEVDEDRDVDESSPQDSPPSKASPAQDGRPPQTAAREATSIPGFPAEGAIPLPVDFLSKVSTEIPASEPDGPSVGRAKGQDAPLEFTFHVEITPNVQKEQAHSEEHLGRAAFPGAPGEGPEARGPSLGEDTKEADLPEPSEKQPAAAPRGKPVSRVPQLKARMVSKSKDGTGSDDKKAKTSTRSSAKTLKNRPCLSPKHPTPGSSDPLIQPSSPAVCPEPPSSPKYVSSVTSRTGSSGAKEMKLKGADGKTKIATPRGAAPPGQKGQANATRIPAKTPPAPKTPPSSATKQVQRRPPPAGPRSERGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 779 - protein, 144 aa, Human
MADRLTQLQDAVNSLADQFCNAIGVLQQCGPPASFNNIQTAINKDQPANPTEEYAQLFAALIARTAKDIDVLIDSLPSEESTAALQAASLYKLEEENHEAATCLEDVVYRGDMLLEKIQSALADIAQSQLKTRSGTHSQSLPDS

SEQ ID NO: 780 - protein, 888 aa, Human
MAGAAAESGRELWTFAGSRDPSAPRLAYGYGPGSLRELRAREFSRLAGTVYLDHAGATLFSQSQLESFTSDLMENTYGNPHSQNISSKLTHDTVEQVRYRILAHFHTTAEDYTVIFTAGSTAALKLVAEAFPWVSQGPESSGSRFCYLTDSHTSVVGMRNVTMAINVISTPVRPEDLWSAEERSASASNPDCQLPHLFCYPAQSNFSGVRYPLSWIEEVKSGRLHPVSTPGKWFVLLDAASYVSTSPLDLSAHQADFVPISFYKIFGFPTGLGALLVHNRAAPLLRKTYFGGGTASAYLAGEDFYIPRQSVAQRFEDGTISFLDVIALKHGFDTLERLTGGMENIKQHTFTLAQYTYVALSSLQYPNGAPVVRIYSDSEFSSPEVQGPIINFNVLDDKGNIIGYSQVDKMASLYNIHLRTGCFCNTGACQRHLGISNEMVRKHFQAGHVCGDNMDLIDGQPTGSVRISFGYMSTLDDVQAFLRFIIDTRLHSSGDWPVPQAHADTGETGAPSADSQADVIPAVMGRRSLSPQEDALTGSRVWNNSSTVNAVPVAPPVCDVARTQPTPSEKAAGVLEGALGPHVVTNLYLYPIKSCAAFEVTRWPVGNQGLLYDRSWMVVNHNGVCLSQKQEPRLCLIQPFIDLRQRIMVIKAKGMEPIEVPLEENSERTQIRQSRVCADRVSTYDCGEKISSWLSTFFGRPCHLIKQSSNSQRNAKKKHGKDQLPGTMATLSLVNEAQYLLINTSSILELHRQLNTSDENGKEELFSLKDLSLRFRANIIINGKRAFEEEKWDEISIGSLRFQVLGPCHRCQMICIDQQTGQRNQHVFQKLSESRETKVNFGMYLMHASLDLSSPCFLSVGSQVLPVLKENVEGHDLPASEKHQDVTS

SEQ ID NO: 781 - protein, 92 aa, Human [sequence omitted]

SEQ ID NO: 782 - protein, 372 aa, Human
MAAERQEALREFVAVTGAEEDRARFFLESAGWDLQIALASFYEDGGDEDIVTISQATPSSVSRGTAPSDNRVTSFRDLIHDQDEDEEEEEGQRSRFYAGGSERSGQQIVGPPRKKSPNELVDDLFKGAKEHGAVAVERVTKSPGETSKPRPFAGGGYRLGAAPEEESAYVAGEKRQHSSQDVHVVLKLWKSGFSLDNGELRSYQDPSNAQFLESIRRGEVPAELRRLAHGGQVNLDMEDHRDEDFVKPKGAFKAFTGEGQKLGSTAPQVLSTSSPAQQAENEAKASSSILIDESEPTTNIQIRLADGGRLVQKFNHSHRISDIRLFIVDARPAMAATSFILMTTFPNKELADESQTLKEANLLNAVIVQRLT

SEQ ID NO: 783 - protein, 440 aa, Human
MALLVLGLVSCTFFLAVNGLYSSSDDVIELTPSNFNREVIQSDSLWLVEFYAPWCGHCQRLTPEWKKAATALKDVVKVGAVDADKHHSLGGQYGVQGFPTIKIFGSNKNRPEDYQGGRTGEAIVDAALSALRQLVKDRLGGRSGGYSSGKQGRSDSSSKKDVIELTDDSFDKNVLDSEDVWMVEFYAPWCGHCKNLEPEWAAAASEVKEQTKGKVKLAAVDATVNQVLASRYGIRGFPTIKIFQKGESPVDYDGGRTRSDIVSRALDLFSDNAPPPELLEIINEDIAKRTCEEHQLCVVAVLPHILDTGAAGRNSYLEVLLKLADKYKKKMWGWLWTEAGAQSELETALGIGGFGYPAMAAINARKMKFALLKGSFSEQGINEFLRELSFGRGSTAPVGGGAFPTIVEREPWDGRDGELPVEDDIDLSDVELDDLGKDEL

SEQ ID NO: 784 - protein, 570 aa, Human
MQLEYETQIKKMLCSKDSLGLKEELTDEDREKVAVHEGINSGTAMSRGLYQPATIFMGRQMSAILSMRDFSTEHKSPQPTKNFSIPDPHSHRQTAQSSNVTDSCVVQTSNDTQCLNKSDNIDGKASLQIGEKMPVTASVLSEEEQTHCLEIGSNTRHGKSNLSEGKKSAELNSPLRERLSPENRTTDLKCDSSSGSEGEILTREHIEVEEKRASPPVSPIPVSEYCESENKWSQEKHSPWEGVSDHLAHREPKSQKPFRKMQEEEEESWSTSSDLTISISEDDLILESPEPQPNPGGKMEGEDGIEALKLIHAEQERVALSTEKNCILQTLSSPDSEKESSTNAPTREPGQTPDSDVPRAQVGQHVATLKEHDNSVKEEATALLRKALTEECGRRSAIHSSESSCSLPSILNDNSGIKEAKPAVWLNSVPTREQEVSSGCGDKSKKENVAADIPITETEAYQLLKKATLQDNTNQTENRFQKTDASVSHLSGLNIGSGAFETKTANKIASEASFSSSEGSPLSRHENKKKPVINLKSNALWDESDDSNSEIEAALRPRNHNTDDSDDFYD

SEQ ID NO: 785 - protein, 1838 aa, Human
MALQLWALTLLGLLGAGASLRPRKLDFFRSEKELNHLAVDEASGVVYLGAVNALYQLDAKLQLEQQVATGPALDNKKCTPPIEASQCHEAEMTDNVNQLLLLDPPRKRLVECGSLFKGICALRALSNISLRLFYEDGSGEKSFVASNDEGVATVGLVSSTGPGGDRVLFVGKGNGPHDNGIIVSTRLLDRTDSREAFEAYTDHATYKAGYLSTNTQQFVAAFEDGPYVFFVFNQQDKHPARNRTLLARMCREDPNYYSYLEMDLQCRDPDIHAAAFGTCLAASVAAPGSGRVLYAVFSRDSRSSGGPGAGLCLFPLDKVHAKMEANRNACYTGTREARDIFYKPFHGDIQCGGHAPGSSKSFPCGSEHLPYPLGSRDGLRGTAVLQRGGLNLTAVTVAAENNHTVAFLGTSDGRILKVYLTPDGTSSEYDSILVEINKRVKRDLVLSGDLGSLYAMTQDKVFRLPVQECLSYPTCTQCRDSQDPYCGWCVVEGRCTRKAECPRAEEASHWLWSRSKSCVAVTSAQPQNMSRRAQGEVQLTVSPLPALSEEDELLCLFGESPPHPARVEGEAVICNSPSSIPVTPPGQDHVAVTIQLLLRRGNIFLTSYQYPFYDCRQAMSLEENLPCISCVSNRWTCQWDLRYHECREASPNPEDGIVRAHMEDSCPQFLGPSPLVIPMNHETDVNFQGKNLDTVKGSSLHVGSDLLKFMEPVTMQESGTFAFRTPKLSHDANETLPLHLYVKSYGKNIDSKLHVTLYNCSFGRSDCSLCRAANPDYRCAWCGGQSRCVYEALCNTTSECPPPVITRIQPETGPLGGGIRITILGSNLGVQAGDIQRISVAGRNCSFQPERYSVSTRIVCVIEAAETPFTGGVEVDVFGKLGRSPPNVQFTFQQPKPLSVEPQQGPQAGGTTLTIHGTHLDTGSQEDVRVTLNGVPCKVTKFGAQLQCVTGPQATRGQMLLEVSYGGSPVPNPGIFFTYRENPVLRAFEPLRSFASGGRSINVTGQGFSLIQRFAMVVIAEPLQSWQPPREAESLQPMTVVGTDYVFHNDTKVVFLSPAVPEEPEAYNLTVLIEMDGHRALLRTEAGAFEYVPDPTFENFTGGVKKQVNKLIHARGTNLNKAMTLQEAEAFVGAERCTMKTLTETDLYCEPPEVQPPPKRRQKRDTTHNLPEFIVKFGSREWVLGRVEYDTRVSDVPLSLILPLVIVPMVVVIAVSVYCYWRKSQQAEREYEKIKSQLEGLEESVRDRCKKEFTDLMIEMEDQTNDVHEAGIPVLDYKTYTDRVFFLPSKDGDKDVMITGKLDIPEPRRPVVEQALYQFSNLLNSKSFLINFIHTLENQREFSARAKVYFASLLTVALHGKLEYYTDIMHTLFLELLEQYVVAKNPKLMLRRSETVVERMLSNWMSICLYQYLKDSAGEPLYKLFKAIKHQVEKGPVDAVQKKAKYTLNDTGLLGDDVEYAPLTVSVIVQDEGVDAIPVKVLNCDTISQVKEKIIDQVYRGQPCSCWPRPDSVVLEWRPGSTAQILSDLDLTSQREGRWKRVNTLMHYNVRDGATLILSKVGVSQQPEDSQQDLPGERHALLEEENRVWHLVRPTDEVDEGKSKRGSVKEKERTKAITEIYLTRLLSVKGTLQQFVDNFFQSVLAPGHAVPPAVKYFFDFLDEQAEKHNIQDEDTIHIWKTNSLPLRFWVNILKNPHFIFDVHVHEVVDASLSVIAQTFMDACTRTEHKLSRDSPSNKLLYAKEISTYKKMVEDYYKGIRQMVQVSDQDMNTHLAEISRAHTDSLNTLVALHQLYQYTQKYYDEIINALEEDPAAQKMQLAFRLQQIAAALENKVTDL

SEQ ID NO: 786 - protein, 202 aa, Human
MCRTLAAFPTTCLERAKEFKTRLGIFLHKSELGCDTGSTGKFEWGSKHSKENRNFSEDVLGWRESFDLLLSSKNGVAAFHAFLKTEFSEENLEFWLACEEFKKIRSATKLASRAHQIFEEFICSEAPKEVNIDHETHELTRMNLQTATATCFDAAQGKTRTLMEKDSYPRFLKSPAYRDLAAQASAASATLSSCSLDEPSHT

SEQ ID NO: 787 - protein, 190 aa, Human
MSTRKRRGGAINSRQAQKRTREATSTPEISLEAEPIELVETAGDEIVDLTCESLEPVVVDLTHNDSVVIVDERRRPRRNARRLPQDHADSCVVSSDDEELSRDRDVYVTTHTPRNARDEGATGLRPSGTVSCPICMDGYSEIVQNGRLIVSTECGHVFCSQCLRDSLKNANTCPTCRKKINHKRYHPIYI

SEQ ID NO: 788 - protein, 297 aa, Human [sequence omitted]

SEQ ID NO: 789 - protein, 92 aa, Human
MSELEKAMVALIDVFHQYSGREGDKHKLKKSELKELINNELSHFLEEIKEQEVVDKVMETLDNDGDGECDFQEFMAFVAMVTTACHEFFEHE

SEQ ID NO: 790 - protein, 290 aa, Human
MAPKRQSPLPPQKKKPRPPPALGPEETSASAGLPKKGEKEQQEAIEHIDEVQNEIDRLNEQASEEILKVEQKYNKLRQPFFQKRSELIAKIPNFWVTTFVNHPQVSALLGEEDEEALHYLTRVEVTEFEDIKSGYRIDFYFDENPYFENKVLSKEFHLNESGDPSSKSTEIKWKSGKDLTKRSSQTQNKASRKRQHEEPESFFTWFTDHSDAGADELGEVIKDDIWPNPLQYYLVPDMDDEEGEGEEDDDDDEEEEGLEDIDEEGDEDEGEEDEDDDEGEEGEEDEGEDD

SEQ ID NO: 791 - protein, 707 aa, Human
MSRDRFRSRGGGGGGFHRRGGGGGRGGLHDFRSPPPGMGLNQNRGPMGPGPGQSGPKPPIPPPPPHQQQQQPPPQQPPPQQPPPHQPPPHPQPHQQQQPPPPPQDSSKPVVAQGPGPAPGVGSAPPASSSAPPATPPTSGAPPGSGPGPTPTPPPAVTSAPPGAPPPTPPSSGVPTTPPQAGGPPPPPAAVPGPGPGPKQGPGPGGPKGGKMPGGPKPGGGPGLSTPGGHPKPPHRGGGEPRGGRQHHPPYHQQHHQGPPPGGPGGRSEEKISDSEGFKANLSLLRRPGEKTYTQRCRLFVGNLPADITEDEFKRLFAKYGEPGEVFINKGKGFGFIKLESRALAEIAKAELDDTPMRGRQLRVRFATHAAALSVRNLSPYVSNELLEEAFSQFGPIERAVVIVDDRGRSTGKGIVEFASKPAARKAFERCSEGVFLLTTTPRPVIVEPLEQLDDEDGLPEKLAQKNPMYQKERETPPRFAQHGTFEYEYSQRWKSLDEMEKQQREQVEKNMKDAKDKLESEMEDAYHEHQANLLRQDLMRRQEELRRMEELHNQEMQKRKEMQLRQEEERRRREEEMMIRQREMEEQMRRQREESYSRMGYMDPRERDMRMGGGGAMNMGDPYGSGGQKFPPLGGGGGIGYEANPGVPPATMSGSMMGSDMRTERFGQGGAGPVGGQGPRGMGPGTPAGYGRGREEYEGPNKKPRF

SEQ ID NO: 792 - protein, 352 aa, Human
MSVAGLKKQFHKATQKVSEKVGGAEGTKLDDDFKEMERKVDVTSRAVMEIMTKTIEYLQPNPASRAKLSMINTMSKIRGQEKGPGYPQAEALLAEAMLKFGRELGDDCNFGPALGEVGEAMRELSEVKDSLDIEVKQNFIDPLQNLHDKDLREIQHHLKKLEGRRLDFDYKKKRQGKIPDEELRQALEKFDESKEIAESSMFNLLEMDIEQVSQLSALVQAQLEYHKQAVQILQQVTVRLEERIRQASSQPRREYQPKPRMSLEFPTGDSTQPNGGLSHTGTPKPSGVQMDQPCCRALYDFEPENEGELGFKEGDIITLTNQIDENWYEGMLHGHSGFFPINYVEILVALPH

SEQ ID NO: 793 - protein, 599 aa, Human
MGPKRRQLTFREKSRIIQEVEENPDLRKGEIARRFNIPPSTLSTILKNKRAILASERKYGVASTCRKTNKLSPYDKLEGLLIAWFQQIRAAGLPVKGIILKEKALRIAEELGMDDFTASNGWLDRFRRRHGVVSCSGVARARARNAAPRTPAAPASPAAVPSEGSGGSTTGWRAREEQPPSVAEGYASQDVFSATETSLWYDFLPDQAAGLCGGDGRPRQATQRLSVLLCANADGSEKLPPLVAGKSAKPRAGQAGLPCDYTANSKGGVTTQALAKYLKALDTRMAAESRRVLLLAGRLAAQSLDTSGLRHVQLAFFPPGTVHPLERGVVQQVKGHYRQAMLLKAMAALEGQDPSGLQLGLTEALHFVAAAWQAVEPSDIAACFREAGFGGGPNATITTSLKSEGEEEEEEEEEEEEEEGEGEEEEEEGEEEEEEGGEGEELGEEEEVEEEGDVDSDEEEEEDEESSSEGLEAEDWAQGVVEAGGSFGAYGAQEEAQCPTLHFLEGGEDSDSDSEEEDDEEEDDEDEDDDDDEEDGDEVPVPSFGEAMAYFAMVKRYLTSFPIDDRVQSHILHLEHDLVHVTRKNHARQAGVRGLGHQS

SEQ ID NO: 794 - protein, 714 aa, Human
MARAGSCGGAAAGAGRPEPWELSLEEVLKAYEQPLNEEQAWAVCFQGCRGLRGSPGRRLRDTGDLLLRGDGSVGAREPEAAEPATMVVPLASSEAQTVQSLGFAIYRALDWGLDESEERELSPQLERLIDLMANNDSEDSGCGAADEGYGGPEEEEEAEGVPRSVRTFAQAMRLCAARLTDPRGAQAHYQAVCRALFVETLELRAFLARVREAKEMLQKLREDEPHLETPRAELDSLGHTDWARLWVQLMRELRRGVKLKKVQEQEFNPLPTEFQLTPFEMLMQDIRARNYKLRKVMVDGDIPPRVKKDAHELILDFIRSRPPLKQVSERRLRPLPPKQRSLHEKILEEIKQERRLRPVRGEGWAARGFGSLPCILNACSGDAKSTSCINLSVTDAGGSAQRPRPRVLLKAPTLAEMEEMNTSEEEESPCGEVTLKRDRSFSEHDLAQLRSEVASGLQSATHPPGGTEPPRPRAGSAHVWRPGSRDQGTCPASVSDPSHPLLSNRGSSGDRPEASMTPDAKHLWLEFSHPVESLALTVEEVMDVRRVLVKAEMEKFLQNKELFSSLKKGKICCCCRAKFPLFSWPPSCLFCKRAVCTSCSIKMKMPSKKFGHIPVYTLGFESPQRVSAAKTAPIQRRDIFQSLQGPQWQSVEEAFPHIYSHGCVLKDVCSECTSFVADVVRSSRKSVDVLNTTPRRSRQTQSLYIPNTRTLDFK

SEQ ID NO: 795 - protein, 2477 aa, Human
MDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQKLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDSLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGITIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKDWWKVEVNDRQGFVPAAYVKKLDPAQSASRENLLEEQGSIALRQEQIDNQTRITKEAGSVSLRMKQVEELYHSLLELGEKRKGMLEKSCKKFMLFREANELQQWINEKEAALTSEEVGADLEQVEVLQKKFDDFQKDLKANESRLKDINKVAEDLESEGLMAEEVQAVQQQEVYGMMPRDETDSKTASPWKSARLMVHTVATFNSIKELNERWRSLQQLAEERSQLLGSAHEVQRFHRDADETKEWIEEKNQALNTDNYGHDLASVQALQRKHEGFERDLAALGDKVNSLGETAERLIQSHPESAEDLQEKCTELNQAWSSLGKRADQRKAKLGDSHDLQRFLSDFRDLMSWINGIRGLVSSDELAKDVTGAEALLERHQEHRTEIDARAGTFQAFEQFGQQLLAHGHYASPEIKQKLDILDQERADLEKAWVQRRMMLDQCLELQLFHRDCEQAENWMAAREAFLNTEDKGDSLDSVEALIKKHEDFDKAINVQEEKIAALQAFADQLIAAGHYAKGDISSRRNEVLDRWRRLKAQMIEKRSKLGESQTLQQFSRDVDEIEAWISEKLQTASDESYKDPTNIQLSKLLSKHQKHQAFEAELHANADRIRGVIDMGNSLIERGACAGSEDAVKARLAALADQWQFLVQKSAEKSQKLKEANKQQNFNTGIKDFDFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 796 - protein, 408 aa, Human
MAENGDNEKMAALEAKICHQIEYYFGDFNLPRDKFLKEQIKLDEGWVPLEIMIKFNRLNRLTTDFNVIVEALSKSKAELMEISEDKTKIRRSPSKPLPEVTDEYKNDVKNRSVYIKGFPTDATLDDIKEWLEDKGQVLNIQMRRTLHKAFKGSIFVVFDSIESAKKFVETPGQKYKETDLLILFKDDYFAKKNEERKQNKVEAKLRAKQEQEAKQKLEEDAEMKSLEEKIGCLLKFSGDLDDQTCREDLHILFSNHGEIKWIDFVRGAKEGIILFKEKAKEALGKAKDANNGNLQLRNKEVTWEVLEGEVEKEALKKIIEDQQESLNKWKSKGRRFKGKGKGNKAAQPGSGKGKVQFQGKKTKFASDDEHDEHDENGATGPVKRAREETDKEEPASKQQKTENGAGDQ

SEQ ID NO: 797 - protein, 243 aa, Human
MAAIAASEVLVDSAEEGSLAAAAELAAQKREQRLRKFRELHLMRNEARKLNHQEVVEEDKRLKLPANWEAKKARLEWELKEEEKKKECAARGEDYEKVKLLEISAEDAERWERKKKRKNPDLGFSDYAAAQLRQYHRLTKQIKPDMETYERLREKHGEEFFPTSNSLLHGTHVPSTEEIDRMVIDLEKQIEKRDKYSRRRPYNDDADIDYINERNAKFNKKAERFYGKYTAEIKQNLERGTAV

SEQ ID NO: 798 - protein, 169 aa, Human
MCHRKPGTPGVGKTTLGKELASKSGLKYINVGDLAREEQLYDGYDEEYDCPILDEDRVVDELDNQMREGGVIVDYHGCDFFPERWFHIVFVLRTDTNVLYERLETRGYNEKKLTDNIQCEIFQVLYEEATASYKEEIVHQLPSNKPEELENNVDQILKWIEQWIKDHNS

SEQ ID NO: 799 - protein, 561 aa, Human
MSTERTSWTSLSTIQKIALGLGIPASATVAYILYRRYRESREERLTFVGEDDIEIEMRVPQEAVKLIIGRQGANIKQLRKQTGARIDVDTEDVGDERVLLISGFPVQVCKAKAAIHQILTENTPVSEQLSVPQRSVGRIIGRGGETIRSICKASGAKITCDKESEGTLLLSRLIKISGTQKEVAAAKHLILEKVSEDEELRKRIAHSAETRVPRKQPISVRREDMTEPGGAGEPALWKNTSSSMEPTAPLVTPPPKGGGDMAVVVSKEGSWEKPSDDSFQKSEAQAIPEMPMFEIPSPDFSFHADEYLEVYVSASEHPNHFWIQIVGSRSLQLDKLVNEMTQHYENSVPEDLTVHVGDIVAAPLPTNGSWYRARVLGTLENGNLDLYFVDFGDNGDCPLKDLRALRSDFLSLPFQAIECSLARIAPSGDQWEEEALDEFDRLTHCADWKPLVAKISSYVQTGISTWPKIYLYDTSNGKKLDIGLELVHKGYAIELPEDIEENRAVPDMLKDMATETDASLSTLLTETKKSSGEITHTLSCLSLSEAASMSGDDNLEDDYLL

SEQ ID NO: 800 - protein, 292 aa, Human
MGEKSENCGVPEDLLNGLKVTDTQEAECAGPPVPDPKNQHSQSKLLRDDEAHLQEDQGEEECFHDCSASFEEEPGADKVENKSNEDVNSSELDEEYLIELEKNMSDEEKQKRREESTRLKEEGNEQFKKGDYIEAESSYSRALEMCPSCFQKERSILFSNRAAARMKQDKKEMAINDCSKAIQLNPSYIRAILRRAELYEKTDKLDEALEDYKSILEKDPSIHQAREACMRLPKQIEERNERLKEEMLGKLKDLGNLVLRPFGLSTENFQIKQDSSTGSYSINFVQNPNNNR

SEQ ID NO: 801 - protein, 2481 aa, Human
MEQSPPPAPEPTQGPTPARSRRRREPESPPASAPIPLFGADTIGQRSPDGPVLSKAEFVEKVRQSNQACHDGDFHTAIVLYNEALAVDPQNCILYSNRSAAYMKIQQYDKALDDAIKARLLNPKWPKAYFRQGVALQYLGRHADALAAFASGLAQDPKSLQLLVGMVEAAMKSPMRDSLEPTYQQLQKMKLDKSPFVVVSVVGQELLTAGHHGASVVVLEAALKIGTCSLKLRGSVFSALSSAYWSLGNTEKSTGYMQQDLDVAKTLGDQTGECRAHGNLGSAFFSKGNYREALTNHRHQLVLAMKLKDREAASSALSSLGHVYTAIGDYPNALASHKQCVLLAKQSKDELSEARELGNMGAVYIAMGDFENAVQCHEQHLKIAKDLGNKREEARAYSNLGSAYHYRRNFDKAMSYHNYVLELAQELMEKAIEMRAYAGLGHAARCMQDLERAKQYHEQQLGIAEDLKDRAAEGRASSNLGIIHQMKGDYDTALKLHKTHLCIAQELSDYAAQGRAYGNMGNAYNALGMYDQAVKYHRQELQISMEVNDRASQASTHGNLAVAYQALGAHDRALQHYQNHLNIARELRDIQSEARALSNLGNFHCSRGEYVQAAPYYEQYLRLAPDLQDMEGEGKVCHNLGYAHYCLGNYQEAVKYYEQDLALAKDLHDKLSQAKAYCNLGLAFKALLNFSKAEECQKYLLSLAQSLNNSQAKFRALGNLGDIFICKKDINGAIKFYEQQLGLAHQVKDRRLEASAYAALGTAYRMIQKYDKALGYHTQELEVYQELSDLPGECRAHGHLAAVYMALGKYTMAFKCYEEQLDLGQKLKDPSLEAQVYGNMGITKMNMNVMEEAIGYFEQQLAMLQQLSGNESVLDRGRAYGNLGDCYEALGDYEEAIKYYEQYLSVAQSLNRMQDQAKAYRGLGNGHRAMGSLQQALVCFEKRLVVAHELGEAFNKAQAYGELGSLHSQLGNYEQAISCLERQLNIARDMKDRALESDAACGLGGVYQQMGEYDTALQYHQLDLQIAEETNNPTCQGRAYGNLGLTYESLGTFERAVVYQEQHLSIAAQMNDLAAKTVSYSSLGRTHHALQNYSQAVMYLQEGLRLAEQLGRREDEAKIRHGLGLSLWASGNLEEAQHQLYRASALFETIRHEAQLSTDYKLSLFDLQTSSYQALQRVLVSLGHHDEALAVAERGRTRAFADLLVERQTGQQDSDPYSPVTIDQILEMVNGQRGLVLYYSLAAGYLYSWLLAPGAGIVKFHEHYLGENTVENSSDFQASSSVTLPTATGSALEQHIASVREALGVESHYSRACASSETESEAGDIMDQQFEEMNNKLNSVTDPTGFLRMVRRNNLFNRSCQSMTSLFSNTVSPTQDGTSSLPRRQSSFAKPPLRALYDLLIAPMEGGLMHSSGPVGRHRQLILVLEGELYLIPFALLKGSSSNEYLYERFGLLAVPSIRSLSVQSKSHLRKNPPTYSSSTSMAAVIGNPKLPSAVMDRWLWGPMPSAEEEAYMVSELLGCQPLVGSVATKERVMSALTQAECVHFATHISWKLSALVLTPSMDGNPASSKSSFGHPYTIPESLRVQDDASDGESISDCPPLQELLLTAADVLDLQLPVKLVVLGSSQESNSKVTADGVIALTRAFLAAGAQCVLVSLWPVPVAASKMFIHAFYSSLLNGLKASAALGEAMKVVQSSKAFSHPSNWAGFMLIGSDVKLNSPSSLIGQALTEILQHPERARDALRVLLHLVEKSLQRIQNGQRNAMYTSQQSVENKVGGIPGWQALLTAVGFRLDPPTSGLPAAVFFPTSDPGDRLQQCSSTLQSLLGLPNPALQALCKLITASETGEQLISRAVKNMVGMLHQVLVQLQAGEKEQDLASAPIQVSISVQLWRLPGCHEFLAALGFDLCEVGQEEVILKTGKQANRRTVHFALQSLLSLFDSTELPKRLSLDSSSSLESLASAQSVSNALPLGYQQPPFSPTGADSIASDAISVYSLSSIASSMSFVSKPEGGSEGGGPGGRQDHDRSKNAYLQRSTLPRSQLPPQTRPAGNKDEEEYEGFSIISNEPLATYQENRNTCFSPDHKQPQPGTAGGMRVSVSSKGSISTPNSPVKMTLIPSPNSPFQKVGKLASSDTGESDQSSTETDSTVKSQEESNPKLDPQELAQKILEETQSHLIAVERLQRSGGQVSKSNNPEDGVQAPSSTAVFRASETSAFSRPVLSHQKSQPSPVTVKPKPPARSSSLPKVSSGYSSPTTSEMSIKDSPSQHSGRPSPGCDSQTSQLDQPLFKLKYPSSPYSAHISKSPRNMSPSSGHQSPAGSAPSPALSYSSAGSARSSPADAPDIDKLKMAAIDEKVQAVHNLKMFWQSTPQHSTGPMKIFRGAPGTMTSKRDVLSLLNLSPRHNKKEEGVDKLELKELSLQQHDGAPPKAPPNGHWRTETTSLGSLPLPAGPPATAPARPLRLPSGNGYKFLSPGRFFPSSKC

SEQ ID NO: 802 - protein, 349 aa, Human
MAHQTGIHATEELKEFFAKARAGSVRLIKVVIEDEQLVLGASQEPVGRWDQDYDRAVLPLLDAQQPCYLLYRLDSQNAQGFEWLFLAWSPDNSPVRLKMLYAATRATVKKEFGGGHIKDELFGTVKDDLSFAGYQKHLSSCAAPAPLTSAERELQQIRINEVKTEISVESKHQTLQGLAFPLQPEAQRALQQLKQKMVNYIQMKLDLERETIELVHTEPTDVAQLPSRVPRDAARYHFFLYKHTHEGDPLESVVFIYSMPGYKCSIKERMLYSSCKSRLLDSVEQDFHLEIAKKIEIGDGAELTAEFLYDEVHPKQHAFKQAFAKPKGPGGKRGHKRLIRGPGENGDDS

SEQ ID NO: 803 - protein, 1119 aa, Human
MMTSVSSDHCRGAREKPQISAAQSTQPQKQVVQATAEQMRLAQVIFDKNDSDFEAKVKQLMEVTGKNQDECIVALHDCNGDVNKAINILLEGNSDTTSWETVGCKKKNFAKENSENKENREKKSEKESSRGRGNNNRKGRGGNRGREFRGEENGIDCNQVDKPSDRGKRARGRGFGRGRGRGAGRFSTQGMGTFNPADYSDSTSTDVCGTKLVVWEAAQNGADEGTELASNTHNIAQDLSNKSSYGLKGAWKNSVEEWTTEDWTEDLSETKVFTASSAPAENHILPGQSIDLVALLQKPVPHSQASEANSFETSQQQGFGQALVFTNSQHNNQMAPGTGSSTAVNSCSPQSLSSVLGSGFGELAPPKMANITSSQILDQLKAPSLGQFTTTPSTQQNSTSHPTTTTSWDLKPPTSQSSVLSHLDFKSQPEPSPVLSQLSQRQQHQSQAVTVPPPGLESFPSQAKLRESTPGDSPSTVNKLLQLPSTTIENISVSVHQPQPKHIKLAKRRIPPASKIPASAVEMPGSADVTGLNVQFGALEFGSEPSLSEFGSAPSSENSNQIPISLYSKSLSEPLNTSLSMTSAVQNSTYTTSVITSCSLTSSSLNSASPVAMSSSYDQSSVHNRIPYQSPVSSSESAPGTIMNGHGGGRSQQTLDTPKTTGPPSALPSVSSLPSTTSCTALLPSTSQHTGDLTSSPLSQLSSSLSSHQSSLSAHAALSSSTSHTHASVESASSHQSSATFSTAATSVSSSASSGVSLSSSMNTANSLCLGGTPASASSSSSRAAPLVTSGKAPPNLPQGVPPLLHNQYLVGPGGLLPAYPIYGYDELQMLQSRLPVDYYGIPFAAPTALASRDGSLANNPYPGDVTKFGRGDSASPAPATTPAQPQQSQSQTHHTAQQPFVNPALPPGYSYTGLPYYTGMPSAFQYGPTMFVPPASAKQHGVNLSTPTPPFQQASGYGQHGYSTGYDDLTQGTAAGDYSKGGYAGSSQAPNKSAGSGPGKGVSVSSSTTGLPDMTGSVYNKTQTFDKQGFHAGTPPPFSLPSVLGSTGPLASGAAPGYAPPPFLHILPAHQQPHSQLLHHHLPQDAQSGSGQRSQPSSLQPKSQASKPAYGNSPYWTN

SEQ ID NO: 804 - protein, 240 aa, Human
MKVKKGGGGAGTATESAPGPSGQSVAPIPQPPAESESGSESEPDAGPGPRPGPLQRKQPIGPEDVLGLQRITGDYLCSPEENIYKIDFVRFKIRDMDSGTVLFEIKKPPVSERLPINRRDLDPNAGRFVRYQFTPAFLRLRQVGATVEFTVGDKPVNNFRMIERHYFRNQLLKSFDFHFGFCIPSSKNTCEHIYDFPPLSEELISEMIRHPYETQSDSFYFVDDRLVMHNKADYSYSGTP

SEQ ID NO: 805 - protein, 794 aa, Human
MEGSLAGSLAAPDRPQGPERLPGPAPRENIEGGAEAAEGEGGIFRSTRYLPVTKEGPRDILDGRGGISVANFDPGTFSLMRCDFCGAGFDTRAGLSSHARAHLRDFGITNWELTVSPINILQELLATSAAEQPPSPLGREPGGPPGSFLTSRRPRLPLTVPFPPTWAEDPGPAYGDASGPEPARDIRCEFCGEFFENRKGLSSHARSHLRQMGVTEWYVNGSPIDTLREILKRRTQSRPGGPPNPPGPSPKALAKMMGGAGPGSSLEARSPSDLHISPLAKKLPPPPGSPLGHSPTASPPPTARKMFPGLAAPSLPKKLKPEQIRVEIKREMLPGALHGELHPSEGPWGAPREDMTPLNLSSRAEPVRDIRCEFCGEFFENRKGLSSHARSHLRQMGVTEWSVNGSPIDTLREILKKKSKPCLIKKEPPAGDLAPALAEDGPPTVAPGPVQSPLPLSPLAGRPGKPGAGPAQVPRELSLTPITGAKPSATGYLGSVAAKRPLQEDRLLPAEVKAKTYIQTELPFKAKTLHEKTSHSSTEACCELCGLYFENRKALASHARAHLRQFGVTEWCVNGSPIETLSEWIKHRPQKVGAYRSYIQGGRPFTKKFRSAGHGRDSDKRPSLGLAPGGLAVVGRSAGGEPGPEAGRAADGGERPLAASPPGTVKAEEHQRQNINKFERRQARPPDASAARGGEDTNDLQQKLEEVRQPPPRVRPVPSLVPRPPQTSLVKFVGNIYTLKCRFCEVEFQGPLSIQEEWVRHLQRHILEMNFSKADPPPEESQAPQAQTAAAEAP

SEQ ID NO: 806 - protein, 376 aa, Human
MVVVAAAPNPADGTPKVLLLSGQPASAAGAPAGQALPLMVPAQRGASPEAASGGLPQARKRQRLTHLSPEEKALRRKLKNRVAAQTARDRKKARMSELEQQVVDLEEENQKLLLENQLLREKTHGLVVENQELRQRLGMDALVAEEEAEAKGNEVRPVAGSAESAAGAGPVVTPPEHLPMDSGGIDSSDSESDILLGILDNLDPVMFFKCPSPEPASLEELPEVYPEGPSSLPASLSLSVGTSSAKLEAINELIRFDHIYTKPLVLEIPSETESQANVVVKIEEAPLSPSENDHPEFIVSVKEEPVEDDLVPELGISNLLSSSHCPKPSSCLLDAYSDCGYGGSLSPFSDMSSLLGVNHSWEDTFANELFPQLISV

SEQ ID NO: 807 - protein, 2146 aa, Human
MYPNWGRYGGSSHYPPPPVPPPPPVALPEASPGPGYSSSTTPAAPSSSGFMSFREQHLAQLQQLQQMHQKQMQCVLQPHHLPPPPLPPPPVMPGGGYGDWQPPPPPMPPPPGPALSYQKQQQYKHQMLHHQRDGPPGLVPMELESPPESPPVPPGSYMPPSQSYMPPPQPPPSYYPPTSSQPYLPPAQPSPSQSPPSQSYLAPTPSYSSSSSSSQSYLSHSQSYLPSSQASPSRPSQGHSKSQLLAPPPPSAPPGNKTTVQQEPLESGAKNKSTEQQQAAPEPDPSTMTPQEQQQYWYRQHLLSLQQRTKVHLPGHKKGPVVAKDTPEPVKEEVTVPATSQVPESPSSEEPPLPPPNEEVPPPLPPEEPQSEDPEEDARLKQLQAAAAHWQQHQQHRVGFQYQGIMQKHTQLQQILQQYQQIIQPPPHIQTMSVDMQLRHYEMQQQQFQHLYQEWEREFQLWEEQLHSYPHKDQLQEYEKQWKTWQGHMKATQSYLQEKVNSFQNMKNQYMGNMSMPPPFVPYSQMPPPLPTMPPPVLPPSLPPPVMPPALPATVPPPGMPPPVMPPSLPTSVPPPGMPPSLSSAGPPPVLPPPSLSSAGPPPVLPPPSLSSTAPPPVMPLPPLSSATPPPGIPPPGVPQGIPPQLTAAPVPPASSSQSSQVPEKPRPALLPTPVSFGSAPPTTYHPPLQSAGPSEQVNSKAPLSKSALPYSSFSSDQGLGESSAAPSQPITAVKDMPVRSGGLLPDPPRSSYLESPRGPRFDGPRRFEDLGSRCEGPRPKGPRFEGNRPDGPRPRYEGHPAEGTKSKWGMIPRGPASQFYITPSTSLSPRQSGPQWKGPKPAFGQQHQQQPKSQAEPLSGNKEPLADTSSNQQKNFKMQSAAFSIAADVKDVKAAQSNENLSDSQQEPPKSEVSEGPVEPSNWDQNVQSMETQIDKAQAVTQPVPLANKPVPAQSTFPSKTGGMEGGTAVATSSLTADNDFKPVGIGLPHSENNQDKGLPRPDNRDNRLEGNRGNSSSYRGPGQSRMEDTRDKGLVNRGRGQAISRGPGLVKQEDFRDKMMGRREDSREKMNRGEGSRDRGLVRPGSSREKVPGGLQGSQDRGAAGSRERGPPRRAGSQERGPLRRAGSRERIPPRRAGSRERGPPRGPGSRERGLGRSDFGRDRGPFRPEPGDGGEKMYPYHRDEPPRAPWNHGEERGHEEFPLDGRNAPMERERLDDWDRERYWRECERDYQDDTLELYNREDRFSAPPSRSHDGDRRGPWWDDWERDQDMDEDYNREMERDMDRDVDRISRPMDMYDRSLDNEWDRDYGRPLDEQESQFRERDIPSLPPLPPLPPLPPLDRYRDDRWREERNREHGYDRDFRDRGELRIREYPERGDTWREKRDYVPDRMDWERERLSDRWYPSDVDRHSPMAEHMPSSHHSSEMMGSDASLDSDQGLGGVMVLSQRQHEIILKAAQELKMLREQKEQLQKMKDFGSEPQMADHLPPQESRLQNTSSRPGMYPPPGSYRPPPPMGKPPGSIVRPSAPPARSSVPVTRPPVPIPPPPPPPPLPPPPPVIKPQTSAVEQERWDEDSFYGLWDTNDEQGLNSEFKSETAAIPSAPVLPPPPVHSSIPPPGPVPMGMPPMSKPPPVQQTVDYGHGRDISTNKVEQIPYGERITLRPDPLPERSTFETEHAGQRDRYDRERDREPYFDRQSNVIADHRDFKRDRETHRDRDRDRGVIDYDRDRFDRERRPRDDRAQSYRDKKDHSSSRRGGFDRPSYDRKSDRPVYEGPSMFGGERRTYPEERMPLPAPSLSHQPPPAPRVEKKPESKNVDDILKPPGRESRPERIVVIMRGLPGSGKTHVAKLIRDKEVEFGGPAPRVLSLDDYFITEVEKEEKDPDSGKKVKKKVMEYEYEAEMEETYRTSMFKTFKKTLDDGFFPFIILDAINDRVRHFDQFWSAAKTKGFEVYLAEMSADNQTCGKRNIHGRKLKEINKMADHWETAPRHMMRLDIRSLLQDAAIEEVEMEDFDANIEEQKEEKKDAEEEESELGYIPKSKWEMDTSEAKLDKLDGLRTGTKRKRDWEAIASRMEDYLQLPDDYDTRASEPGKKRVRWADLEEKKDADRKRAIGFVVGQTDWEKITDESGHLAEKALNRTKYI

SEQ ID NO: 808 - protein, 241 aa, Human
MNSGRPETMENLPALYTIFQGEVAMVTDYGAFIKIPGCRKQGLVHRTHMSSCRVDKPSEIVDVGDKVWVKLIGREMKNDRIKVSLSMKVVNQGTGKDLDPNNVIIEQEERRRRSFQDYTGQKITLEAVLNTTCKKCGCKGHFAKDCFMQPGGTKYSLIPDEEEEKEEAKSAEFEKPDPTRNPSRKRKKEKKKKKHRDRKSSDSDSSDSESDTGKRARHTSKDSKAAKKKKKKKKHKKKHKE

SEQ ID NO: 809 - protein, 271 aa, Human
MTRWARVSTTYNKRPLPATSWEDMKKGSFEGTSQNLPKRKQLEANRLSLKNDAPQAKHKKNKKKKEYLNEDVNGFMEYLRQNSQMVHNGQIIATDSEEVREEIAVALKKDSRREGRRLKRQAAKKNAMVCFHCRKPGHGIADCPAALENQDMGTGICYRCGSTEHEITKCKAKVDPALGEFPFAKCFVCGEMGHLSRSCPDNPKGLYADGGGCKLCGSVEHLKKDCPESQNSERMVTVGRWAKGMSADYEEILDVPKPQKPKTKIPKVVNF

SEQ ID NO: 810 - protein, 127 aa, Human
MPEVSSKGATISKKGFKKAVVKTQKKEGKKRKRTRKESYSIYIYKVLKQVHPDTGISSKAMSIMNSFVTDIFERIASEASRLAHYSKRSTISSREIQTAVRLLLPGELAKHAVSEGTKAVTKYTSSK

SEQ ID NO: 811 - protein, 370 aa, Human
MARPGLIHSAPGLPDTCALLQPPAASAAAAPSMSGPDVETPSAIQICRIMRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLMDEVAGIVAARHCKTNIVTASVDAINFHDKIRKGCVITISGRMTFTSNKSMEIEVLVDADPVVDSSQKRYRAASAFFTYVSLSQEGRSLPVPQLVPETEDEKKRFEEGKGRYLQMKAKRQGHAEPQP

SEQ ID NO: 812 - protein, 376 aa, Human
MESYDIIANQPVVIDNGSGVIKAGFAGDQIPKYCFPNYVGRPKHMRVMAGALEGDLFIGPKAEEHRGLLTIRYPMEHGVVRDWNDMERIWQYVYSKDQLQTFSEEHPVLLTEAPLNPSKNREKAAEVFFETFNVPALFISMQAVLSLYATGRTTGVVLDSGDGVTHAVPIYEGFAMPHSIMRVDIAGRDVSRYLRLLLRKEGVDFHTSAEFEVVRTIKERACYLSINPQKDEALETEKVQYTLPDGSTLDVGPARFRAPELLFQPDLVGDESEGLHEVVAFAIHKSDMDLRRTLFANIVLSGGSTLFKGFGDRLLSEVKKLAPKDIKIKISAPQERLYSTWIGGSILASLDTFKKMWVSKKEYEEDGSRAIHRKTF

SEQ ID NO: 813 - protein, 737 aa, Human
MNGDSRAAVVTSPPPTTAPHKERYFDRVDENNPEYLRERNMAPDLRQDFNMMEQKKRVSMILQSPAFCEELESMIQEQFKKGKNPTGLLALQQIADFMTTNVPNVYPAAPQGGMAALNMSLGMVTPVNDLRGSDSIAYDKGEKLLRCKLAAFYRLADLFGWSQLIYNHITTRVNSEQEHFLIVPFGLLYSEVTASSLVKINLQGDIVDRGSTNLGVNQAGFTLHSAIYAARPDVKCVVHIHTPAGAAVSAMKCGLLPISPEALSLGEVAYHDYHGILVDEEEKVLIQKNLGPKSKVLILRNHGLVSVGESVEEAFYYIHNLVVACEIQVRTLASAGGPDNLVLLNPEKYKAKSRSPGSPVGEGTGSPPKWQIGEQEFEALMRMLDNLGYRTGYPYRYPALREKSKKYSDVEVPASVTGYSFASDGDSGTCSPLRHSFQKQQREKTRWLNSGRGDEASEEGQNGSSPKSKTKWTKEDGHRTSTSAVPNLFVPLNTNPKEVQEMRNKIREQNLQDIKTAGPQSQVLCGVVMDRSLVQGELVTASKAIIEKEYQPHVIVSTTGPNPFTTLTDRELEEYRREVERKQKGSEENLDEAREQKEKSPPDQPAVPHPPPSTPIKLEEDLVPEPTTGDDSDAATFKPTLPDLSPDEPSEALGFPMLEKEEEAHRPPSPTEAPTEASPEPAPDPAPVAEEAAPSAVEEGAAADPGSDGSPGKSPSKKKKKFRTPSFLKKSKKKSDS

SEQ ID NO: 814 - protein, 261 aa, Human
MEKVRREGVKVMPNAIVQSVGVSSGKLLIKLKDGRKVETDHIVAAVGLEPNVELAKTGGLEIDSDFGGFRVNAELQARSNIWVAGDAACFYDIKLGRRRVEHHDHAVVSGRLAGENMTGAAKPYWHQSMFWSDLGPDVGYEAIGLVDSSLPTVGVFAKATAQDNPKSATEQSGTGIRSESETESEASEITIPPSTPAVPQAPVQGEDYGKGVIFYLRDKVVVGIVLWNIFNRMPIARKIIKDGEQHEDLNEVAKLFNIHED

SEQ ID NO: 815 - protein, 194 aa, Human
MEEKLKKTKIIFVVGGPGSGKGTQCEKIVQKYGYTHLSTGDLLRSEVSSGSARGKKLSEIMEKGQLVPLETVLDMLRDAMVAKVNTSKGFLIDGYPREVQQGEEFERRIGQPTLLLYVDAGPETMTQRLLKRGETSGRVDDNEETIKKRLETYYKATEPVIAFYEKRGIVRKVNAEGSVDSVFSQVCTHLDALK

SEQ ID NO: 816 - protein, 903 aa, Human
MAIQFRSLFPLALPGMLALLGWWWFFSRKKGHVSSHDEQQVEAGAVQLRADPAIKEPLPVEDVCPKVVSTPPSVTEPPEKELSTVSKLPAEPPALLQTHPPCRRSESSGILPNTTDMRLRPGTRRDDSTKLELALTGGEAKSIPLECPLSSPKGVLFSSKSAEVCKQDSPFSRVPRKVQPGYPVVPAEKRSSGERARETGGAEGTGDAVLGEKVLEEALLSREHVLELENSKGPSLASLEGEEDKGKSSSSQVVGPVQEEEYVAEKLPSRFIESAHTELAKDDAAPAPPVADAKAQDRGVEGELGNEESLDRNEEGLDRNEEGLDRNEESLDRNEEGLDRNEEIKRAAFQIISQVISEATEQVLATTVGKVAGRVCQASQLQGQKEESCVPVHQKTVLGPDTAEPATAEAAVAPPDAGLPLPGLPAEGSPPPKTYVSCLKSLLSSPTKDSKPNISAHHISLASCLALTTPSEELPDRAGILVEDATCVTCMSDSSQSVPLVASPGHCSDSFSTSGLEDSCTETSSSPRDKAITPPLPESTVPFSNGVLKGELSDLGAEDGWTMDAEADHSGGSDRNSMDSVDSCCSLKKTESFQNAQAGSNPKKVDLIIWEIEVPKHLVGRLIGKQGRYVSFLKQTSGAKIYISTLPYTQSVQICHIEGSQHHVDKALNLIGKKFKELNLTNIYAPPLPSLALPSLPMTSWLMLPDGITVEVIVVNQVNAGHLFVQQHTHPTFHALRSLDQQMYLCYSQPGIPTLPTPVEITVICAAPGADGAWWRAQVVASYEETNEVEIRYVDYGGYKRVKVDVLRQIRSDFVTLPFQGAEVLLDSVMPLSDDDQFSPEADAAMSEMTGNTALLAQVTSYSPTGLPLIQLWSVVGDEVVLINRSLVERGLAQWVDSYYTSL

SEQ ID NO: 817 - protein, 480 aa, Human [sequence omitted]

SEQ ID NO: 818 - protein, 808 aa, Human
MLRFPTCFPSFRVVGEKQLPQEIIFLVWSPKRDLIALANTAGEVLLHRLASFHRVWSFPPNENTGKEVTCLAWRPDGKLLAFALADTKKIVLCDVEKPESLHSFSVEAPVSCMHWMEVTVESSVLTSFYNAEDESNLLLPKLPTLPKNYSNTSKIFSEENSDEIIKLLGDVRLNILVLGGSSGFIELYAYGMFKIARVTGIAGTCLALCLSSDLKSLSVVTEVSTNGASEVSYFQLETNLLYSFLPEVTRMARKFTHISALLQYINLSLTCMCEAWEEILMQMDSRLTKFVQEKNTTTSVQDEFMHLLLWGKASAELQTLLMNQLTVKGLKKLGQSIESSYSSIQKLVISHLQSGSESLLYHLSELKGMASWKQKYEPLGLDAAGIEEAITAVGSFILKANELLQVIDSSMKNFKAFFRWLYVAMLRMTEDHVLPELNKMTQKDITFVAEFLTEHFNEAPDLYNRKGKYFNVERVGQYLKDEDDDLVSPPNTEGNQWYDFLQNSSHLKESPLLFPYYPRKSLHFVKRRMENIIDQCLQKPADVIGKSMNQAICIPLYRDTRSEDSTRRLFKFPFLWNNKTSNLHYLLFTILEDSLYKMCILRRHTDISQSVSNGLIAIKFGSFTYATTEKVRRSIYSCLDAQFYDDETVTVVLKDTVGREGRDRLLVQLPLSLVYNSEDSAEYQFTGTYSTRLDEQCSAIPTRTMHFEKHWRLLESMKAQYVAGNGFRKVSCVLSSNLRHVRVFEMDIDDEWELDESSDEEEEASNKPVKIKEEVLSESEAENQQAGAAALAPEIVIKVEKLDPELDS

SEQ ID NO: 819 - protein, 361 aa, Human
MAQPGDPRRLCRLVQEGRLRALKEELQAAGGCPGPAGDTLLHCAARHGHRDVLAYLAEAWGMDIEATNRDYKRPLHEAASMGHRDCVRYLLGRGAAVDCLKKADWTPLMMACTRKNLGVIQELVEHGANPLLKNKDGWNSFHIASREGDPLILQYLLTVCPGAWKTESKIRRTPLHTAAMHGHLEAVKVLLKRCQYEPDYRDNCGVTALMDAIQCGHIDVARLLLDEHGACLSAEDSLGAQALHRAAVTGQDEAIRFLVSELGVDVDVRATSTHLTALHYAAKEGHTSTIQTLLSLGADINSKDEKNRSALHLACAGQHLACAKFLLQSGLKDSEDITGTLAQQLPRRADVLQGSGHSAMT

SEQ ID NO: 820 - protein, 871 aa, Human
MGEGGLPPAFQLLLRACDQGDTETARRLLEPGAAEPAERGAEPEAGAEPAGAEVAGPGAAAAGAVGAPVPVDCSDEAGNTALQFAAAGGHEPLVRFLLRRGASVNSRNHYGWSALMQAARFGHVSVAHLLLDHGADVNAQNRLGASVLTVASRGGHLGVVKLLLEAGAFVDHHHPSGEQLGLGGSRDEPLDITALMAAIQHGHEAVVRLLMEWGADPNHAARTVGWSPLMLAALTGRLGVAQQLVEKGANPDHLSVLEKTAFEVALDCKHRDLVDYLDPLTTVRPKTDEEKRRPDIFHALKMGNFQLVKEIADEDPSHVNLVNGDGATPLMLAAVTGQLALVQLLVERHADVDKQDSVHGWTALMQATYHGNKEIVKYLLNQGADVTLRAKNGYTAFDLVMLLNDPDTELVRLLASVCMQVNKDKGRPSHQPPLPHSKVRQPWSIPVLPDDKGGLKSWWNRMSNRFRKLKLMQTLPRGLSSNQPLPFSDEPEPALDSTMRAAPQDKTSRSALPDAAPVTKDNGPGSTRGEKEDTLLTTMLRNGAPLTRLPSDKLKAVIPPFLPPSSFELWSSDRSRTRHNGKADPMKTALPQRASRGHPVGGGGTDTTPVRPVKFPSLPRSPASSANSGNFNHSPHSSGGSSGVGVSRHGGELLNRSGGSIDNVLSQIAAQRKKAAGLLEQKPSHRSSPVGPAPGSSPSELPASPAGGSAPVGKKLETSKRPPSGTSTTSKSTSPTLTPSPSPKGHTAESSVSSSSSHRQSKSSGGSSSGTITDEDELTGILKKLSLEKYQPIFEEQEVDMEAFLTLTDGDLKELGIKTDGSRQQILAAISELNAGKGRERQILQETIHNFHSSFESSASNTRAPGNSPCA

SEQ ID NO: 821 - protein, 2843 aa, Human
MAAASYDQLLKQVEALKMENSNLRQELEDNSNHLTKLETEASNMKEVLKQLQGSIEDEAMASSGQIDLLERLKELNLDSSNFPGVKLRSKMSLRSYGSREGSVSSRSGECSPVPMGSFPRRGFVNGSRESTGYLEELEKERSLLLADLDKEEKEKDWYYAQLQNLTKRIDSLPLTENFSLQTDMTRRQLEYEARQIRVAMEEQLGTCQDMEKRAQRRIARIQQIEKDILRIRQLLQSQATEAERSSQNKHETGSHDAERQNEGQGVGEINMATSGNGQGSTTRMDHETASVLSSSSTHSAPRRLTSHLGTKVEMVYSLLSMLGTHDKDDMSRTLLAMSSSQDSCISMRQSGCLPLLIQLLHGNDKDSVLLGNSRGSKEARARASAALHNIIHSQPDDKRGRREIRVLHLLEQIRAYCETCWEWQEAHEPGMDQDKNPMPAPVEHQICPAVCVLMKLSFDEEHRHAMNELGGLQAIAELLQVDCEMYGLTNDHYSITLRRYAGMALTNLTFGDVANKATLCSMKGCMRALVAQLKSESEDLQQVIASVLRNLSWRADVNSKKTLREVGSVKALMECALEVKKESTLKSVLSALWNLSAHCTENKADICAVDGALAFLVGTLTYRSQTNTLAIIESGGGILRNVSSLIATNEDHRQILRENNCLQTLLQHLKSHSLTIVSNACGTLWNLSARNPKDQEALWDMGAVSMLKNLIHSKHKMIAMGSAAALRNLMANRPAKYKDANIMSPGSSLPSLHVRKQKALEAELDAQHLSETFDNIDNLSPKASHRSKQRHKQSLYGDYVFDTNRHDDNRSDNFNTGNMTVLSPYLNTTVLPSSSSSRGSLDSSRSEKDRSLERERGIGLGNYHPATENPGTSSKRGLQISTTAAQIAKVMEEVSAIHTSQEDRSSGSTTELHCVTDERNALRRSSAAHTHSNTYNFTKSENSNRTCSMPYAKLEYKRSSNDSLNSVSSSDGYGKRGQMKPSIESYSEDDESKFCSYGQYPADLAHKIHSANHMDDNDGELDTPINYSLKYSDEQLNSGRQSPSQNERWARPKHIIEDEIKQSEQRQSRNQSTTYPVYTESTDDKHLKFQPHFGQQECVSPYRSRGANGSETNRVGSNHGINQNVSQSLCQEDDYEDDKPTNYSERYSEEEQHEEEERPTNYSIKYNEEKRHVDQPIDYSLKYATDIPSSQKQSFSFSKSSSGQSSKTEHMSSSSENTSTPSSNAKRQNQLHPSSAQSRSGQPQKAATCKVSSINQETIQTYCVEDTPICFSRCSSLSSLSSAEDEIGCNQTTQEADSANTLQIAEIKEKIGTRSAEDPVSEVPAVSQHPRTKSSRLQGSSLSSESARHKAVEFSSGAKSPSKSGAQTPKSPPEHYVQETPLMFSRCTSVSSLDSFESRSIASSVQSEPCSGMVSGIISPSDLPDSPGQTMPPSRSKTPPPPPQTAQTKREVPKNKAPTAEKRESGPKQAAVNAAVQRVQVLPDADTLLHFATESTPDGFSCSSSLSALSLDEPFIQKDVELRIMPPVQENDNGNETESEQPKESNENQEKEAEKTIDSEKDLLDDSDDDDIEILEECIISAMPTKSSRKAKKPAQTASKLPPPVARKPSQLPVYKLLPSQNRLQPQKHVSFTPGDDMPRVYCVEGTPINFSTATSLSDLTIESPPNELAAGEGVRGGAQSGEFEKRDTIPTEGRSTDEAQGGKTSSVTIPELDDNKAEEGDILAECINSAMPKGKSHKPFRVKKIMDQVQQASASSSAPNKNQLDGKKKKPTSPVKPIPQNTEYRTRVRKNADSKNNLNAERVFSDNKDSKKQNLKNNSKVFNDKLPNNEDRVRGSFAFDSPHHYTPIEGTPYCFSRNDSLSSLDFDDDDVDLSREKAELRKAKENKESEAKVTSHTELTSNQQSANKTQAIAKQPINRGQPKPILQKQSTFPQSSKDIPDRGAATDEKLQNFAIENTPVCFSHNSSLSSLSDIDQENNNKENEPIKETEPPDSQGEPSKPQASGYAPKSFHVEDTPVCFSRNSSLSSLSIDSEDDLLQECISSAMPKKKKPSRLKGDNEKHSPRNMGGILGEDLTLDLKDIQRPDSEHGLSPDSENFDWKAIQEGANSIVSSLHQAAAAACLSRQASSDSDSILSLKSGISLGSPFHLTPDQEEKPFTSNKGPRILKPGEKSTLETKKIESESKGIKGGKKVYKSLITGKVRSNSEISGQMKQPLQANMPSISRGRTMIHIPGVRNSSSSTSPVSKKGPPLKTPASKSPSEGQTATTSPRGAKPSVKSELSPVARQTSQIGGSSKAPSRSGSRDSTPSRPAQQPLSRPIQSPGRNSISPGRNGISPPNKLSQLPRTSSPSTASTKSSGSGKMSYTSPGRQMSQQNLTKQTGLSKNASSIPRSESASKGLNQMNNGNGANKKVELSRMSSTKSSGSESDRSERPVLVRQSTFIKEAPSPTLRRKLEESASFESLSPSSRPASPTRSQAQTPVLSPSLPDMSLSTHSSVQAGGWRKLPPNLSPTIEYNDGRPAKRHDIARSHSESPSRLPINRSGTWKREHSKHSSSLPRVSTWRRTGSSSSILSASSESSEKAKSEDEKHVNSISGTKQSKENQVSAKGTWRKIKENEFSPTNSTSQTVSSGATNGAESKTLIYQMAPAVSKTEDVWVRIEDCPINNPRSGRSPTGNTPPVIDSVSEKANPNIKDSKDNQAKQNVGNGSVPMRTVGLENRLNSFIQVDAPDQKGTEIKPGQNNPVPVSETNESSIVERTPFSSSSSSKHSSPSGTVAARVTPFNYNPSPRKSSADSTSARPSQIPTPVNNNTKKRDSKTDSTESSGTQSPKRHSGSYLVTSV

SEQ ID NO: 822 - protein, 201 aa, Human
MTEKAPEPHVEEDDDDELDSKLNYKPPPQKSLKELQEMDKDDESLIKYKKTLLGDGPVVTDPKAPNVVVTRLTLVCESAPGPITMDLTGDLEALKKETIVLKEGSEYRVKIHFKVNRDIVSGLKYVQHTYRTGVKVDKATFMVGSYGPRPEEYEFLTPVEEAPKGMLARGTYHNKSFFTDDDKQDHLSWEWNLSIKKEWTE

SEQ ID NO: 823 - protein, 392 aa, Human
MPFLHGFRRIIFEYQPLVDAILGSLGIQDPERQESLDRPSYVASEESRILVLTELLERKAHSPFYQEGVSNALLKMAELGLTRAADVLLRHGANLNFEDPVTYYTALHIAVLRNQPDMVELLVHHGADVNRRDRIHESSPLDLASEEPERLPCLQRLLDLGADVNAADKHGADVKATTKDGDTVFTCIIFLLGETVGGDKEEAQMINRFCFQVTRLLLAHGADPSECPAHESLTHICLKSFKLHFPLLRFLLESGAAYNCSLHGASCWSGFHIIFERLCSHPGCTEDESHADLLRKAETVLDLMVTNSQKLQLPENFDIHPVGSLAEKIQALHFSLRQLESYPPPLKHLCRVAIRLYLQPWPVDVKVKALPLPDRLKWYLLSEHSGSVEDDI

SEQ ID NO: 824 - protein, 168 aa, Human
MLPAALLRRPGLGRLVRHARAYAEAAAAPAAASGPNQMSFTFASPTQVFFNGANVRQVDVPTLTGAFGILAAHVPTLQVLRPGLVVVHAEDGTTSKYFVSSGSIAVNADSSVQLLAEEAVTLDMLDLGAAKANLEKAQAELVGTADEATRAEIQIRIEANEALVKALE

SEQ ID NO: 825 - protein, 137 aa, Human
MAGRKLALKTIDWVAFAEIIPQNQKAIASSLKSWNETLTSRLAALPENPPAIDWAYYKANVAKAGLVDDFEKKVKSCAEWVSLSKARIVEYEKEMEKMKNLIPFDQMTIEDLNEAFPETKLDKKKYPYWPHQPIENL

SEQ ID NO: 826 - protein, 147 aa, Human
MGTPASVVSEPPPWQAPIEARGRKQASANIFQDAELLQIQALFQRSGDQLAEERAQIIWECAGDHRVAEALKRLRRKRPPRQKPLGHSLHHCSRLRILEPHSALANPQSATETASSEQYLHSRKKSARIRRNWRKSGPTSYLHQIRH

SEQ ID NO: 827 - protein, 361 aa, Human
MSGAGVGGASEESQAMQAHVSIILPVHNAEPWLDECLRSVLQQDFEGTMELSVFNDASKDKSGAIIEKWRVKLEDSGVHVIIGGHDSPSPRGVGYAKNQAVAQSSGSYLCFLDSDDVMMPQRVRLQHEAAVQHPSSIIGCRVRRDPPNSTERYTRWINQLTPEQLLTQVFTSNGPTVIMPTWFCSRAWFSHVGPFNEGGQGVPEDLLFFYEHLRKGGGVIRVDQSLLLYRHHPQAATHCVLETTIWTHRVRFLEEQALPRWAAFTIWNAGKQGRRLYRSLTAGSQRKVVAFCDVDENKIRKGFYCHEDSQERPKPRIPILHFRAARPPFVICVKLDLTGGAFEDNLRSLHLQEGQDFLHFS

SEQ ID NO: 828 - protein, 445 aa, Human
MAVAIAAARVWRLNRGLSQAALLLLRQPGARGLARSHPPRQQQQFSSLDDKPQFPGASAEFIDKLEFIQPNVISGIPIYRVMDRQGQIINPSEDPHLPKEKVLKLYKSMTLLNTMDRILYESQRQGRISFYMTNYGEEGTHVGSAAALDNTDLVFGQYREAGVLMYRDYPLELFMAQCYGNISDLGKGRQMPVHYGCKERHFVTISSPLATQIPQAVGAAYAAKRANANRVVICYFGEGAASEGDAHAGFNFAATLECPIIFFCRNNGYAISTPTSEQYRGDGIAARGPGYGIMSIRVDGNDVFAVYNATKEARRRAVAENQPFLIEAMTYRIGHHSTSDDSSAYRSVDEVNYWDKQDHPISRLRHYLLSQGWWDEEQEKAWRKQSRRKVMEAFEQAERKPKPNPNLLFSDVYQEMPAQLRKQQESLARHLQTYGEHYPLDHFDK

SEQ ID NO: 829 - protein, 1205 aa, Human
MRKPRRKSRQNAEGRRSPSPYSLKCSPTRETLTYAQAQRIVEVDIDGRLHRISIYDPLKIITEDELTAQDITECNSNKENSEQPQFPGKSKKPSSKGKKKESCSKHASGTSFHLPQPSFRMVDSGIQPEAPPLPAAYYRYIEKPPEDLDAEVEYDMDEEDLAWLDMVNEKRRVDGHSLVSADTFELLVDRLEKESYLESRSSGAQQSLIDEDAFCCVCLDDECHNSNVILFCDICNLAVHQECYGVPYIPEGQWLCRCCLQSPSRPVDCILCPNKGGAFKQTSDGHWAHVVCAIWIPEVCFANTVFLEPIEGIDNIPPARWKLTCYICKQKGLGAAIQCHKVNCYTAFHVTCAQRAGLFMKIEPMRETSLNGTIFTVRKTAYCEAHSPPGAATARRKGDSPRSISETGDEEGLKEGDGEEEEEEEVEEEEQEAQGGVSGSLKGVPKKSKMSLKQKIKKEPEEAGQDTPSTLPMLAVPQIPSYRLNKICSGLSFQRKNQFMQRLHNYWLLKRQARNGVPLIRRLHSHLQSQRNAEQREQDEKTSAVKEELKYWQKLRHDLERARLLIELIRKREKLKREQVKVQQAAMELELMPFNVLLRTTLDLLQEKDPAHIFAEPVNLSEVPDYLEFISKPMDFSTMRRKLESHLYRTLEEFEEDFNLIVTNCMKYNAKDTIFHRAAVRLRDLGGAILRHARRQAENIGYDPERGTHLPESPKLEDFYRFSWEDVDNILIPENRAHLSPEVQLKELLEKLDLVSAMRSSGARTRRVRLLRREINALRQKLAQPPPPQPPSLNKTVSNGELPAGPQGDAAVLEQALQEEPEDDGDRDDSKLPPPPTLEPTGPAPSLSEQESPPEPPTLKPINDSKPPSRFLKPRKVEEDELLEKSPLQLGNEPLQRLLSDNGINRLSLMAPDTPAGTPLSGVGRRTSVLFKKAKNGVKLQRSPDRVLENGEDHGVAGSPASPASIEEERHSRKRPRSRSCSESEGERSPQQEEETGMTNGFGKHTESGSDSECSLGLSGGLAFEACSGLTPPKRSRGKPALSRVPFLEGVNGDSDYNGSGRSLLLPFEDRGDLEPLELVWAKCRGYPSYPALIIDPKMPREGLLHNGVPIPVPPLDVLKLGEQKQAEAGEKLFLVLFFDNKRTWQWLPRDKVLPLGVEDTVDKLKMLEGRKTSIRKSVQVAYDRAMIHLSRVRGPHSFVTSSYL

SEQ ID NO: 830 - protein, 150 aa, Human
MAASQCLCCSKFLFQRQNLACFLTNPHCGSLVNADGHGEVWTDWNNMSKFFQYGWRCTTNENTYSNRTLMGNWNQERYDLRNIVQPKPLPSQFGHYFETTYDTSYNNKMPLSTHRFKREPHWFPGHQPELDPPRYKCTEKSTYMNSYSKP

SEQ ID NO: 831 - protein, 381 aa, Human
MALKAEGAALDCFEVTLKCEEGEDEEEAMVVAVIPRPEPMLRVTQQEKTPPPRPSPLEAGSDGCEEPKQQVSWEQEFLVGSSPGGSGRALCMVCGAEIRAPSADTARSHILEQHPHTLDLSPSEKSNILEAWSEGVALLQDVRAEQPSPPNSDSGQDAHPDPDANPDAARMPAEIVVLLDSEDNPSLPKRSRPRGLRPLELPAVPATEPGNKKPRGQRWKEPPGEEPVRKKRGRPMTKNLDPDPEPPSPDSPTETFAAPAEVRHFTDGSFPAGFVLQLFSHTQLRGPDSKDSPKDREVAEGGLPRAESPSPAPPPGLRGTLDLQVIRVRMEEPPAVSLLQDWSRHPQGTKRVGAGDTSDWPTVLSESSTTVAGKPEKGNGV

SEQ ID NO: 832 - protein, 296 aa, Human
MGLSHSKTHLRVIKVAPLQNKEVETPSAGRVDFAFNQNLEEKTSYSLARLQDQNKALEGQLPPLQENWYGRYSTASRDMYFDIPLEHRETSIIKRHPPQRLQKLEPIDLPRVITSGRLLSQREARTMHKAKQVLEKKMQTPMYTSENRQYLHKMQVLEMIRKRQEAQMELKKSLHGEARINKQSPRDHKAKKTLQSTPRNDDHDLLTMLPDEILNRGPGNSKNTEFLKHQAVNNYCPWKIGKMETWLHEQEAQGQLLWDSSSSDSDEQGKDEKKPRALVRTRTERIPLFDEFFDQE

SEQ ID NO: 833 - protein, 204 aa, Human
MGEAEVGGGGAAGDKGPGEAATSPAEETVVWSPEVEVCLFHAMLGHKPVGVNRHFHMICIRDKFSQNIGRQVPSKVIWDHLSTMYDMQALHESEILPFPNPERNFVLPEEIIQEVREGKVMIEEEMKEEMKEDVDPHNGADDVFSSSGSLGKASEKSSKDKEKNSSDLGCKEGADKRKRSRVTDKVLTANSNPSSPSAAKRRRT

SEQ ID NO: 834 - protein, 285 aa, Human
MEVPPPAPRSFLCRALCLFPRVFAAEAVTADSEVLEERQKRLPYVPEPYYPESGWDRLRELFGKDEQQRISKDLANICKTAATAGIIGWVYGGIPAFIHAKQQYIEQSQAEIYHNRFDAVQSAHRAATRGFIRYGWRWGWRTAVFVTIFNTVNTSLNVYRNKDALSHFVIAGAVTGSLFRINVGLRGLVAGGIIGALLGTPVGGLLMAFQKYSGETVQERKQKDRKALHELKLEEWKGRLQVTEHLPEKIESSLQEDEPENDAKKIEALLNLPRNPSVIDKQDKD

SEQ ID NO: 835 - protein, 305 aa, Human
MLGRNTWKTSAFSFLVEQMWAPLWSRSMRPGRWCSQRSCAWQTSNNTLHPLWTVPVSVPGGTRQSPINIQWRDSVYDPQLKPLRVSYEAASCLYIWNTGYLFQVEFDDATEASGISGGPLENHYRLKQFHFHWGAVNEGGSEHTVDGHAYPAELHLVHWNSVKYQNYKEAVVGENGLAVIGVFLKLGAHHQTLQRLVDILPEIKHKDARAAMRPFDPSTLLPTCWDYWTYAGSLTTPPLTESVTWIIQKEPVEVAPSQLSAFRTLLFSALGEEEKMMVNNYRPLQPLMNRKVWASFQATNEGTRS

SEQ ID NO: 836 - protein, 271 aa, Human
MAGPQQQPPYLHLAELTASQFLEIWKHFDADGNGYIEGKELENFFQELEKARKGSGMMSKSDNFGEKMKEFMQKYDKNSDGKIEMAELAQILPTEENFLLCFRQHVGSSAEFMEAWRKYDTDRSGYIEANELKGFLSDLLKKANRPYDEPKLQEYTQTILRMFDLNGDGKLGLSEMSRLLPVQENFLLKFQGMKLTSEEFNAIFTFYDKDRSGYIDEHELDALLKDLYEKNKKEMNIQQLTNYRKSVMSLAEAGKLYRKDLEIVLCSEPPM

SEQ ID NO: 837 - protein, 348 aa, Human
MYTAIPQSGSPFPGSVQDPGLHVWRVEKLKPVPVAQENQGVFFSGDSYLVLHNGPEEVSHLHLWIGQQSSRDEQGACAVLAVHLNTLLGERPVQHREVQGNESDLFMSYFPRGLKYQEGGVESAFHKTSTGAPAAIKKLYQVKGKKNIRATERALNWDSFNTGDCFILDLGQNIFAWCGGKSNILERNKARDLALAIRDSERQGKAQVEIVTDGEEPAEMIQVLGPKPALKEGNPEEDLTADKANAQAAALYKVSDATGQMNLTKVADSSPFALELLISDDCFVLDNGLCGKIYIWKGRKANEKERQAALQVAEGFISRMQYAPNTQVEILPQGHESPIFKQFFKDWK

SEQ ID NO: 838 - protein, 428 aa, Human
MALAVAPWGRQWEEARALGRAVRMLQRLEEQCVDPRLSVSPPSLRDLLPRTAQLLREVAHSRRAAGGGGPGGPGGSGDFLLIYLANLEAKSRQVAALLPPRGRRSANDELFRAGSRLRRQLAKLAIIFSHMHAELHALFPGGKYCGHMYQLTKAPAHTFWRESCGARCVLPWAEFESLLGTCHPVEPGCTALALRTTIDLTCSGHVSIFEFDVFTRLFQPWPTLLKNWQLLAVNHPGYMAFLTYDEVQERLQACRDKPGSYLYPDGKTHNPDLTELGQAEPQQRIHVSEEQLQLYWAMDSTFELCKICAESNKDVKIEPCGHLLCSCCLAAWQHSDSQTCPFCRCEIKGWEAVSIYQFHGQATAEDSGNSSDQEGRELELGQVPLSAPPLPPRPDLPPRKPRNAQPKVRLLKGNSPPAALGPQDPAPA

SEQ ID NO: 839 - protein, 951 aa, Human
MHKRKGPPGPPGRGAAAARQLGLLVDLSPDGLMIPEDGANDEELEAEFLALVGGQPPALEKLKGKGPLPMEAIEKMASLCMRDPDEDEEEGTDEDDLEADDDLLAELNEVLGEEQKASETPPPVAQPKPEAPHPGLETTLQERLALYQTAIESARQAGDSAKMRRYDRGLKTLENLLASIRKGNAIDEADIPPPVAIGKGPASTPTYSPAPTQPAPRIASAPEPRVTLEGPSATAPASSPGLAKPQMPPGPCSPGPLAQLQSRQRDYKLAALHAKQQGDTTAAARHFRVAKSFDAVLEALSRGEPVDLSCLPPPPDQLPPDPPSPPSQPPTPATAPSTTEVPPPPRTLLEALEQRMERYQVAAAQAKSKGDQRKARMHERIVKQYQDAIRAHKAGRAVDVAELPVPPGFPPIQGLEATKPTQQSLVGVLETAMKLANQDEGPEDEEDEVPKKQNSPVAPTAQPKAPPSRTPQSGSAPTAKAPPKATSTRAQQQLAFLEGRKKQLLQAALRAKQKNDVEGAKMHLRQAKGLEPMLEASRNGLPVDITKVPPAPVNKDDFALVQRPGPGLSQEAARRYGELTKLIRQQHEMCLNHSNQFTQLGNITETTKFEKLAEDCKRSMDILKQAFVRGLPTPTARFEQRTFSVIKIFPDLSSNDMLLFIVKGINLPTPPGLSPGDLDVFVRFDFPYPNVEEAQKDKTSVIKNTDSPEFKEQFKLCINRSHRGFRRAIQTKGIKFEVVHKGGLFKTDRVLGTAQLKLDALEIACEVREILEVLDGRRPTGGRLEVMVRIREPLTAQQLETTTERWLVIDPVPAAVPTQVAGPKGKAPPVPAPARESGNRSARPLHSLSVLAFDQERLERKILALRQARRPVPPEVAQQYQDIMQRSQWQRAQLEQGGVGIRREYAAQLERQLQFYTEAARRLGNDGSRDAAKEALYRRNLVESELQRLRR

SEQ ID NO: 840 - protein, 289 aa, Human
MAGAGRGAAVSRVQAGPGSPRRARGRQQVQPLGKQRPAPWPGLRSKEKKKVNCKPKNQDEQEIPFRLREIMRSRQEMKNPISNKKRKKAAQVTFRKTLEKEAKGEEPDIAVPKFKQRKGESDGAYIHRMQQEAQHVLFLSKNQAIRQPEVQAAPKEKSEQKKAKKAFQKRRLDKVRRKKEEKAADRLEQELLRDTVKFGEVVLQPPELTARPQRSVSKDQPGRRSQMLRMLLSPGGVSQPLTASLARQRIVEEERERAVQAYRALKQRQQQLHGERPHLTSRKKPEPQL

SEQ ID NO: 841 - protein, 1030 aa, Human
MAEPGGAAGRSHPEDGSASEGEKEGNNESHMVSPPEKDDGQKGEEAVGSTEHPEEVTTQAEAAIEEGEVETEGEAAVEGEEEAVSYGDAESEEEYYYTETSSPEGQISAADTTYPYFSPPQELPGEEAYDSVSGEAGLQGFQQEATGPPESRERRVTSPEPSHGVLGPSEQMGQVTSGPAVGRLTGSTEEPQGQVLPMGVQHRFRLSHGSDIESSDLEEFVSQEPVIPPGVPDAHPREGDLPVFQDQIQQPSTEEGAMAERVESEGSDEEAEDEGSQLVVLDPDHPLMVRFQAALKNYLNRQIEKLKLDLQELVVATKQSRAQRQELGVNLYEVQQHLVHLQKLLEKSHDRHAMASSERRQKEEELQAARALYTKTCAAANEERKKLAALQTEMENLALHLFYMQNIDQDMRDDIRVMTQVVKKAETERIRAEIEKKKQDLYVDQLTTRAQQLEEDIALFEAQYLAQAEDTRILRKAVSEACTEIDAISVEKRRIMQQWASSLVGMKHRDEAHRAVLEALRGCQHQAKSTDGEIEAYKKSIMKEEEKNEKLASILNRTETEATLLQKLTTQCLTKQVALQSQFNTYRLTLQDTEDALSQDQLEQMILTEELQAIRQAIQGELELRRKTDAAIREKLQEHMTSNKTTKYFNQLILRLQKEKTNMMTHLSKINGDIAQTTLDITHTSSRLDAHQKTLVELDQDVKKVNELITNSQSEISRRTILIERKQGLINFLNKQLERMVSELGGEEVGPLELEIKRLSKLIDEHDGKAVQAQVTWLRLQQEMVKVTQEQEEQLASLDASKKELHIMEQKKLRVESKIEQEKKEQKEIEHHMKDLDNDLKKLNMLMNKNRCSSEELEQNNRVTENEFVRSLKASERETIKMQDKLNQLSEEKATLLNQLVEAEHQIMLWEKKIQLAKEMRSSVDSEIGQTEIRAMKGEIHRMKKYCRTTQDAHRHVHEQHGTHAGTCTKNTGRAQARARTTRDARGHVHEQHGTRAGTCTNNTGRAQARARTRDARRHVHEHRTHTARA

SEQ ID NO: 842 - protein, 154 aa, Human
MAAPSEVAAIAPGEGDGGGGGFGSWLDGRLEALGVDRAVYGAYILGILQEEEEEEKLDALQGILSAFLEEDSLLNICKEIVERWSETQNVVTKVKKEDEVQAIATLIEKQAQIVVKPRMVSEEEKQRKAALLAQYADVTDEEDSVPKHQCGRCP

SEQ ID NO: 843 - protein, 780 aa, Human
MGDEKDSWKVKTLDEILQEKKRRKEQEEKAEIKRLKNSDDRDSKRDSLEEGELRDHCMEITIRNSPYRREDSMEDRGEEDDSLAIKPPQQMSRKEKVHHRKDEKRKEKCRHHSHSAEGGKHARVKEREHERRKRHREEQDKARREWERQKRREMAREHSRRERDRLEQLERKRERERKMREQQKEQREQKERERRAEERRKEREARREVSAHHRTMREDYSDKVKASHWSRSPPRPPRERFELGDGRKPVKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGEGTPQSSALTEGDYVPDSPALLPIELKQELPKYLPALQGCRSVEEFQCLNRIEEGTYGVVYRAKDKKTDEIVALKRLKMEKEKEGFPITSLREINTILKAQHPNIVTVREIVVGSNMDKIYIVMNYVEHDLKSLMETMKQPFLPGEVKTLMIQLLRGVKHLHDNWILHRDLKTSNLLLSHAGILKVGDFGLAREYGSPLKAYTPVVVTQWYRAPELLLGAKEYSTAVDMWSVGCIFGELLTQKPLFPGNSEIDQINKVFKELGTPSEKIWPGYSELPVVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 844 - protein, 659 aa, Human
MSLPPEKASELKQLIHQQLSKMDVHGRIREILAETIREELAPDQQHLSTEDLIKALRRRGIIDDVMKELNFVTDSVEQELPSSPKQPICFDRQSTLKKTNIDPTRRYLYLQVLGGKAFLEHLQEPEPLPGQVCSTFTLCLHYRNQRFRSKPVPCACEPDFHDGFLLEVHRESLGDGTRMADSTTMLSISDPIHMVLIKTDIFGETTLVASYFLEWRSVLGSENGVTSLTVELMGVGTESKVSVGILNIKLEMYPPLNQTLSQEVVNTQLALERQKTAEKERLFLVYAKQWWREYLQIRPSHNSRLVKIFAQDENGINRPVCSYVKPLRAGRLLDTPRQAARFVNVLGYERAPVIGGGGKQEQWCTLLAFLCRNKGDCEDHANLLCSLLLGYGLEAFVCVGTKAKGVPHAWVMTCGTDGAITFWESLTGHRYIHKPTNPDEPPVAEQPKPLYPYRTIGCVFNHQMFLGNCQPSDAVETCVFDLNDESKWKPMSEEAIKSVCAPGATTSLPPFPPLCASTIDASVTSNEIEMQLRLLVSEHRKDLGLTTVWEDQLSYLLSPALASYEFERTTSISAGNEEFQDAIRRAVPDGHTFKGFPIHFVYRNARRAFATCLRSPFCEEIICCRGDQVRLAVRVRVFTYPESACAVWIMFACKYRSVL

SEQ ID NO: 845 - protein, 391 aa, Human
MAALTTLFKYIDENQDRYIKKLAKWVAIQSVSAWPEKRGEIRRMMEVAAADVKQLGGSVELVDIGKQKEIPVNVRFCLEGMEESGSEGLDELIFARKDTFFKDVDYVCISDNYWLGKKKPCITYGLRGICYFFIEVECSNKDLHSGVYGGSVHEAMTDLILLMGSLVDKRGNILIPGINEAVAAVTEEEHKLYDDIDFDIEEFAKDVGAQILLHSHKKDILMHRWRYPSLSLHGIEGAFSGSGAKTVIPRKVVGKFSIRLVPNMTPEVVGEQVTSYLTKKFAELRSPNEFKVYMGHGGKPWVSDFSHPHYLAGRRAMKTVFGVEPDLTREGGSIPVTLTFQEATGKNVMLLPVGSADDGAHSQNEKLNRYNYIEGTKMLAAYLYEVSQLKD

SEQ ID NO: 846 - protein, 925 aa, Human
MATSADSPSSPLGAEDLLSDSSEPPGLNQVSSEVTSQLYASLRLSRQAEATARAQLYLPSTSPPHEGLDGFAQELSRSLSVGLEKNLKKKDGSKHIFEMESVRGQLQTMLQTSRDTAYRDPLIPGAGSERREEDSFDSDSTATLLNTRPLQDLSPSSSAQALEELFPRYTSLRPGPPLNPPDFQGLRDALDSEHTRRKHCERHIQSLQTRVLELQQQLAVAVAADRKKDTMIEQLDKTLARVVEGWNRHEAERTEVLRGLQEEHQAAELTRSKQQETVTRLEQSLSEAMEALNREQESARLQQRERETLEEERQALTLRLEAEQQRCCVLQEERDAARAGQLSEHRELETLRAALEEERQTWAQQEHQLKEHYQALQEESQAQLEREKEKSQREAQAAWETQHQLALVQSEVRRLEGELDTARRERDALQLEMSLVQARYESQRIQLESELAVQLEQRVTERLAQAQESSLRQAASLREHHRKQLQDLSGQHQQELASQLAQFKVEMAEREERQQQVAEDYELRLAREQARVCELQSGNQQLEEQRVELVERLQAMLQAHWDEANQLLSTTLPPPNPPAPPAGPSSPGPQEPEKEERRVWTMPPMAVALKPVLQQSREARDELPGAPPVLCSSSSDLSLLLGPSFQSQHSFQPLEPKPDLTSSTAGAFSALGAFHPDHRAERPFPEEDPGPDGEGLLKQGLPPAQLEGLKNFLHQLLETVPQNNENPSVDLLPPKSGPLTVPSWEEAPQVPRIPPPVHKTKVPLAMASSLFRVPEPPSSHSQGSGPSSGSPERGGDGLTFPRQLMEVSQLLRLYQARGWGALPAEDLLLYLKRLEHSGYKPGRKEEGFSGWKLDYGEWSGTDGRGDNVPRRNTDSRLGEIPRKEIPSQAVPRRLATAPKTEKPPARKKSGHPAPSSMRSRGGVWR

SEQ ID NO: 847 - protein, 576 aa, Human
MAASETVRLRLQFDYPPPATPHCTAFWLLVDLNRCRVVTDLISLIRQRFGFSSGAFLGLYLEGGLLPPAESARLVRDNDCLRVKLEERGVAENSVVISNGDINLSLRKAKKRAFQLEEGEETEPDCKYSKKHWKSRENNNNNEKVLDLEPKAVTDQTVSKKNKRKNKATCGTVGDDNEEAKRKSPKKKEKCEYKKKAKNPKSPKVQAVKDWANQRCSSPKGSARNSLVKAKRKGSVSVCSKESPSSSSESESCDESISDGPSKVTLEARNSSEKLPTELSKEEPSTKNTTADKLAIKLGFSLTPSKGKTSGTTSSSSDSSAESDDQCLMSSSTPECAAGFLKTVGLFAGRGRPGPGLSSQTAGAAGWRRSGSNGGGQAPGASPSVSLPASLGRGWGREENLFSWKGAKGRGMRGRGRGRGHPVSCVVNRSTDNQRQQQLNDVVKNSSTIIQNPVETPKKDYSLLPLLAAAPQVGEKIAFKLLELTSSYSPDVSDYKEGRILSHNPETQQVDIEILSSLPALREPGKFDLVYHNENGAEVVEYAVTQESKITVFWKELIDPRLIIESPSNTSSTEPA

SEQ ID NO: 848 - protein, 175 aa, Human
MDIAIHHPWIRRPFFPFHSPSRLFDQFFGEHLLESDLFPTSTSLSPFYLRPPSFLRAPSWFDTGLSEMRLEKDRFSVNLDVKHFSPEELKVKVLGDVIEVHGKHEERQDEHGFISREFHRKYRIPADVDPLTITSSLSSDGVLTVNGPRKQVSGPERTIPITREEKPAVTAAPKK

SEQ ID NO: 849 - protein, 470 aa, Human
MSQAYSSSQRVSSYRRTFGGAPGFPLGSPLSSPVFPRAGFGSKGSSSSVTSRVYQVSRTSGGAGGLGSLRASRLGTTRTPSSYGAGELLDFSLADAVNQEFLTTRTNEKVELQELNDRFANYIEKVRFLEQQNAALAAEVNRLKGREPTRVAELYEEELRELRRQVEVLTNQRARVDVERDNLLDDLQRLKAKLQEEIQLKEEAENNLAAFRADVDAATLARIDLERRIESLNEEIAFLKKVHEEEIRELQAQLQEQQVQVEMDMSKPDLTAALRDIRAQYETIAAKNISEAEEWYKSKVSDLTQAANKNNDALRQAKQEMMEYRHQIQSYTCEIDALKGTNDSLMRQMRELEDRFASEASGYQDNIARLEEEIRHLKDEMARHLREYQDLLNVKMALDVEIATYRKLLEGEESRINLPIQTYSALNFRETSPEQRGSEVHTKKTVMIKTIETRDGEVVSEATQQQHEVL

SEQ ID NO: 850 - protein, 1369 aa, Human
MGGKNKKHKAPAAAVVRAAVSASRAKSAEAGIAGEAQSKKPVSRPATAAAAAAGSREPRVKQGPKIYSFNSTNDSSGPANLDKSILKVVINNKLEQRIIGVINEHKKQNNDKGMISGRLTAKKLQDLYMALQAFSFKTKDIEDAMTNTLLYGGDLHSALDWLCLNLSDDALPEGFSQEFEEQQPKSRPKFQSPQIQATISPPLQPKTKTYEEDPKSKPKKEEKNMEVNMKEWILRYAEQQNEEEKNENSKSLEEEEKFDPNERYLHLAAKLLDAKEQAATFKLEKNKQGQKEAQEKIRKFQREMETLEDHPVFNPAMKISHQQNERKKPPVATEGESALNFNLFEKSAAATEEEKDKKKEPHDVRNFDYTARSWTGKSPKQFLIDWVRKNLPKSPNPSFEKVPVGRYWKCRVRVIKSEDDVLVVCPTILTEDGMQAQHLGATLALYRLVKGQSVHQLLPPTYRDVWLEWSDAEKKREELNKMETNKPRDLFIAKLLNKLKQQQQQQQQHSENKRENSEDPEESWENLVSDEDFSALSLESANVEDLEPVRNLFRKLQSTPKYQKLLKERQQLPVFKHRDSIVETLKRHRVVVVAGETGSGKSTQVPHFLLEDLLLNEWEASKCNIVCTQPRRISAVSLANRVCDELGCENGPGGRNSLCGYQIRMESRACESTRLLYCTTGVLLRKLQEDGLLSNVSHVIVDEVHERSVQSDFLLIILKEILQKRSDLHLILMSATVDSEKFSTYFTHCPILRISGRSYPVEVFHLEDIIEETGFVLEKDSEYCQKFLEEEEEVTINVTSKAGGIKKYQEYIPVQTGAHADLNPFYQKYSSRTQHAILYMNPHKINLDLILELLAYLDKSPQFRNIEGAVLIFLPGLAHIQQLYDLLSNDRRFYSERYKVIALHSILSTQDQAAAFTLPPPGVRKIVLATNIAETGITIPDVVFVIDTGRTKENKYHESSQMSSLVETFVSKASALQRQGRAGRVRDGFCFRMYTRERFEGFMDYSVPEILRVPLEELCLHIMKCNLGSPEDFLSKALDPPQLQVISNAMNLLRKIGACELNEPKLTPLGQHLAALPVNVKIGKMLIFGAIFGCLDPVATLAAVMTEKSPFTTPIGRKDEADLAKSALAMADSDHLTIYNAYLGWKKARQEGGYRSEITYCRRNFLNRTSLLTLEDVKQELIKLVKAAGFSSSTTSTSWEGNRASQTLSFQEIALLKAVLVAGLYDNVGKIIYTKSVDVTEKLACIVETAQGKAQVHPSSVNRDLQTHGWLLYQEKIRYARVYLRETTLITPFPVLLFGGDIEVQHRERLLSIDGWIYFQAPVKIAVIFKQLRVLIDSVLRKKLENPKMSLENDKILQIITELIKTENN

SEQ ID NO: 851 - protein, 1556 aa, Human
MADRSLEGMALPLEVRARLAELELELSEGDITQKGYEKKRSKLIGAYLPQPPRVDQALPQERRAPVTPSSASRYHRRRSSGSRDERYRSDVHTEAVQAALAKHKERKMAVPMPSKRRSLVVQTSMDAYTPPDTSSGSEDEGSVQGDSQGTPTSSQGSINMEHWISQAIHGSTTSTTSSSSTQSGGSGAAHRLADVMAQTHIENHSAPPDVTTYTSEHSIQVERPQGSTGSRTAPKYGNAELMETGDGVPVSSRVSAKIQQLVNTLKRPKRPPLREFFVDDFEELLEVQQPDPNQPKPEGAQMLAMRGEQLGVVTNWPPSLEAALQRWGTISPKAPCLTTMDTNGKPLYILTYGKLWTRSMKVAYSILHKLGTKQEPMVRPGDRVALVFPNNDPAAFMAAFYGCLLAEVVPVPIEVPLTRKDAGSQQIGFLLGSCGVTVALTSDACHKGLPKSPTGEIPQFKGWPKLLWFVTESKHLSKPPRDWFPHIKDANNDTAYIEYKTCKDGSVLGVTVTRTALLTHCQALTQACGYTEAETIVNVLDFKKDVGLWHGILTSVMNMMHVISIPYSLMKVNPLSWIQKVCQYKAKVACVKSRDMHWALVAHRDQRDINLSSLRMLIVADGANPWSISSCDAFLNVFQSKGLRQEVICPCASSPEALTVAIRRPTDDSNQPPGRGVLSMHGLTYGVIRVDSEEKLSVLTVQDVGLVMPGAIMCSVKPDGVPQLCRTDEIGELCVCAVATGTSYYGLSGMTKNTFEVFPMTSSGAPISEYPFIRTGLLGFVGPGGLVFVVGKMDGLMVVSGRRHNADDIVATALAVEPMKFVYRGRIAVFSVTVLHDERIVIVAEQRPDSTEEDSFQWMSRVLQAIDSIHQVGVYCLALVPANTLPKTPLGGIHLSETKQLFLEGSLHPCNVLMCPHTCVTNLPKPRQKQPEIGPASVMVGNLVSGKRIAQASGRDLGQIEDNDQARKFLFLSEVLQWRAQTTPDHILYTLLNCRGAIANSLTCVQLHKRAEKIAVMLMERGHLQDGDHVALVYPPGIDLIAAFYGCLYAGCVPITVRPPHPQNIATTLPTVKMIVEVSRSACLMTTQLICKLLRSREAAAAVDVRTWPLILDTDDLPKKRPAQICKPCNPDTLAYLDFSVSTTGMLAGVKMSHAATSAFCRSIKLQCELYPSREVAICLDPYCGLGFVLWCLCSVYSGHQSILIPPSELETNPALWLLAVSQYKVRDTFCSYSVMELCTKGLGSQTESLKARGLDLSRVRTCVVVAEERPRIALTQSFSKLFKDLGLHPRAVSTSFGCRVNLAICLQGTSGPDPTTVYVDMRALRHDRVRLVERGSPHSLPLMESGKILPGVRIIIANPETKGPLGDSHLGEIWVHSAHNASGYFTIYGDESLQSDHFNSRLSFGDTQTIWARTGYLGFLRRTELTDANGERHDALYVVGALDEAMELRGMRYHPIDIETSVIRAHKSVTECAVFTWTNLLVVVVELDGSEQEALDLVPLVTNVVLEEHYLIVGVVVVVDIGVIPINSRGEKQRMHLRDGFLADQLDPIYVAYNM

SEQ ID NO: 852 - protein, 176 aa, Human
MASSSGNDDDLTIPRAAINKMIKETLPNVRVANDARELVVNCCTEFIHLISSEANEICNKSEKKTISPEHVIQALESLGFGSYISEVKEVLQECKTVALKRRKASSRLENLGIPEEELLRQQQELFAKARQQQAELAQQEWLQMQQAAQQAQLAAASASASNQAGSSQDEEDDDDI

SEQ ID NO: 853 - protein, 187 aa, Human
MSEMAELSELYEESSDLQMDVMPGEGDLPQMEVGSGSRELSLRPSRSGAQQLEEEGPMEEEEAQPMAAPEGKRSLANGPNAGEQPGQVAGADFESEDEGEEFDDWEDDYDYPEEEQLSGAGYRVSAALEEADKMFLRTREPALDGGFQMHYEKTPFDQLAFIEELFSLMVVNRLTEELGCDEIIDRE

SEQ ID NO: 854 - protein, 348 aa, Human
MNMTQARVLVAAVVGLVAVLLYASIHKIEEGHLAVYYRGGALLTSPSGPGYHIMLPFITTFRSVQTTLQTDEVKNVPCGTSGGVMIYIDRIEVVNMLAPYAVFDIVRNYTADYDKTLIFNKIHHELNQFCSAHTLQEVYIELFDQIDENLKQALQKDLNLMAPGLTIQAVRVTKPKIPEAIRRNFELMEAEKTKLLIAAQKQKVVEKEAETERKKAVIEAEKIAQVAKIRFQQKVMEKETEKRISEIEDAAFLAREKAKADAEYYAAHKYATSNKHKLTPEYLELKKYQAIASNSKIYFGSNIPNMFVDSSCALKYSDIRTGRESSLPSKEALEPSGENVIQNKESTG

SEQ ID NO: 855 - protein, 116 aa, Human
MGGCPVRKRRRNGSKEGNHHSTQPKRNKRNPIFQDSQDTEVFSWSDNERSSSRINIPERASGPEGNLNQIVTEPDANFPQFLHEGLSKPVYVINWFMSFGPEIKLNTSQQGRNQAV

SEQ ID NO: 856 - protein, 221 aa, Human
MFGFHKPKMYRSIEGCCICRAKSSSSRFTDSKRYEKDFQSCFGLHETRSGDICNACVLLVKRWKKLPAGSKKNWNHVVDARAGPSLKTTLKPKKVKTLSGNRIKSNQISKLQKEFKRHNSDAHSTTSSASPAQSPCYSNQSDDGSDTEMASGSNRTPVFSFLDLTYWKRQKICCGIIYKGRFGEVLIDTHLFKPCCSNKKAAAEKPEEQGPEPLPISTQEW

SEQ ID NO: 857 - protein, 2511 aa, Human
MEEVVIAGMSGKLPESENLQEFWDNLIGGVDMVTDDDRRWKAGLYGLPRRSGKLKDLSRFDASFFGVHPKQAHTMDPQLRLLLEVTYEAIVDGGINPDSLRGTHTGVWVGVSGSETSEALSRDPETLVGYSMVGCQRAMMANRLSFFFDFRGPSIALDTACSSSLMALQNAYQAIHSGQCPAAIVGGINVLLKPNTSVQFLRLGMLSPEGTCKAFDTAGNGYCRSEGVVAVLLTKKSLARRVYATILNAGTNTDGFKEQGVTFPSGDIQEQLIRSLYQSAGVAPESFEYIEAHGTGTKVGDPQELNGITRALCATRQEPLLIGSTKSNMGHPEPASGLAALAKVLLSLEHGLWAPNLHFHSPNPEIPALLDGRLQVVDQPLPVRGGNVGINSFGFGGSNVHIILRPNTQPPPAPAPHATLPRLLRASGRTPEAVQKLLEQGLRHSQDLAFLSMLNDIAAVPATAMPFRGYAVLGGERGGPEVQQVPAGERPLWFICSGMGTQWRGMGLSLMRLDRFRDSILRSDEAVKPFGLKVSQLLLSTDESTFDDIVHSFVSLTAIQIGLIDLLSCMGLRPDGIVGHSLGEVACGYADGCLSQEEAVLAAYWRGQCIKEAHLPPGAMAAVGLSWEECKQRCPPGVVPACHNSKDTVTISGPQAPVFEFVEQLRKEGVFAKEVRTGGMAFHSYFMEAIAPPLLQELKKVIREPKPRSARWLSTSIPEAQWHSSLARTSSAEYNVNNLVSPVLFQEALWHVPEHAVVLEIAPHALLQAVLKRGLKPSCTIIPLMKKDHRDNLEFFLAGIGRLHLSGIDANPNALFPPVEFPAPRGTPLISPLIKWDHSLAWDVPAAEDFPNGSGSPSAAIYNIDTSSESPDHYLVDHTLDGRVLFPATGYLSIVWKTLARALGLGVEQLPVVFEDVVLHQATILPKTGTVSLEVRLLEASRAFEVSENGNLVVSGKVYQWDDPDPRLFDHPESPTPNPTEPLFLAQAEVYKELRLRGYDYGPHFQGILEASLEGDSGRLLWKDNWVSFMDTMLQMSILGSAKHGLYLPTRVTAIHIDPATHRQKLYTLQDKAQVADVVVSRWLRVTVAGGVHISGLHTESAPRRQQEQQVPILEKFCFTPHTEEGCLSERAALQEELQLCKGLVQALQTKVTQQGLKMVVPGLDGAQIPRDPSQQELPRLLSAACRLQLNGNLQLELAQVLAQERPKLPEDPLLSGLLDSPALKACLDTAVENMPSLKMKVVEVLAGHGHLYSRIPGLLSPHPLLQLSYTATDRHPQALEAAQAELQQHDVAQGQWDPADPAPSALGSADLLVCNCAVAALGDPASALSNMVAALREGGFLLLHTLLRGHPLGDIVAFLTSTEPQYGQGILSQDAWESLFSRVSLRLVGLKKSFYGSTLFLCRRPTPQDSPIFLPVDDTSFRWVESLKGILADEDSSRPVWLKAINCATSGVVGLVNCLRREPGGNRLRCVLLSNLSSTSHVPEVDPGSAELQKVLQGDLVMNVYRDGAWGAFRHFLLEEDKPEEPTAHAFVSTLTRGDLSSIRWVCSSLRHAQPTCPGAQLCTVYYASLNFRDIMLATGKLSPDAIPGKWTSQDSLLGMEFSGRDASGKRVMGLVPAKGLATSVLLSPDFLWDVPSNWTLEEAASVPVVYSTAYYALVVRGRVRPGETLLIHSGSGGVGQAAIAIALSLGCRVFTTVGSAEKRAYLQARFPQLDSTSFANSRDTSFEQHVLWHTGGKGVDLVLNSLAEEKLQASVRCLATHGRFLEIGKFDLSQNHPLGMAIFLKNVTFHGVLLDAFFNESSADWREVWALVQAGIRDGVVRPLKCTVFHGAQVEDAFRYMAQGKHIGKVVVQVLAEEPEAVLKGAKPKLMSAISKTFCPAHKSYIIAGGLGGFGLELAQWLIQRGVQKLVLTSRSGIRTGYQAKQVRRWRRQGVQVQVSTSNISSLEGARGLIAEAAQLGPVGGVFNLAVVLRDGLLENQTPEFFQDVCKPKYSGTLNLDRVTREACPELDYFVVFSSVSCGRGNAGQSNYGFANSAMERICEKRRHEGLPGLAVQWGAIGDVGILVETMSTNDTIVSGTLPQRMASCLEVLDLFLNQPHMVLSSFVLAEKAAAYRDRDSQRDLVEAVAHILGIRDLAAVNLDSSLADLGLDSLMSVEVRQTLERELNLVLSVREVRQLTLRKLQELSSKADEASELACPTPKEDGLAQQQTQLNLRSLLVNPEGPTLMRLNSVQSSERPLFLVHPIEGSTTVFHSLASRLSIPTYGLQCTRAAPLDSIHSLAAYYIDCIRQVQPEGPYRVAGYSYGACVAFEMCSQLQAQQSPAPTHNSLFLFDGSPTYVLAYTQSYRAKLTPGCEAEAETEAICFFVQQFTDMEHNRVLEALLPLKGLEERVAAAVDLIIKSHQGLDRQELSFAARSFYYKLRAAEQYTPKAKYHGNVMLLRAKTGGAYGEDLGADYNLSQVCDGKVSVHVIEGDHRTLLEGSGLESIISIIHSSLAEPRVSVREG

SEQ ID NO: 858 - protein, 374 aa, Human
MWFLTTLLLWVPVDGQVDTTKAVITLQPPWVSVFQEETVTLHCEVLHLPGSSSTQWFLNGTATQTSTPSYRITSASVNDSGEYRCQRGLSGRSDPIQLEIHRGWLLLQVSSRVFTEGEPLALRCHAWKDKLVYNVLYYRNGKAFKFFHWNSNLTILKTNISHNGTYHCSGMGKHRYTSAGISVTVKELFPAPVLNASVTSPLLEGNLVTLSCETKLLLQRPGLQLYFSFYMGSKTLRGRNTSSEYQILTARREDSGLYWCEAATEDGNVLKRSPELELQVLGLQLPTPVWFHVLFYLAVGIMFLVNTVLWVTIRKELKRKKKWDLEISLDSGHEKKVISSLQEDRHLEEELKCQEQKEEQLQEGVHRKEPQGAT

SEQ ID NO: 859 - protein, 1219 aa, Human
MFGAGDEDDTDFLSPSGGARLASLFGLDQAAAGHGNEFFQYTAPKQPKKGQGTAATGNQATPKTAPATMSTPTILVATAVHAYRYTNGQYVKQGKFGAAVLGNHTAREYRILLYISQQQPVTVARIHVNFELMVRPNNYSTFYDDQRQNWSIMFESEKAAVEFNKQVCIAKCNSTSSLDAVLSQDLIVADGPAVEVGDSLEVAYTGWLFQNHVLGQVFDSTANKDKLLRLKLGSGKVIKGWEDGMLGMKKGGKRLLIVPPACAVGSEGVIGWTQATDSILVFEVEVRRVKFARDSGSDGHSVSSRDSAAPSPIPGADNLSADPVVSPPTSIPFKSGEPALRTKSNSLSEQLAINTSPDAVKAKLISRMAKMGQPMLPILPPQLDSNDSEIEDVNTLQGGGQPVVTPSVQPSLHPAHPALPQMTSQAPQPSVTGLQAPSAALMQVSSLDSHSAVSGNAQSFQPYAGMQAYAYPQASAVTSQLQPVRPLYPAPLSQPPHFQGSGDMASFLMTEARQHNTEIRMAVSKVADKMDHLMTKVEELQKHSAGNSMLIPSMSVTMETSMIMSNIQRIIQENERLKQEILEKSNRIEEQNDKISELIERNQRYVEQSNLMMEKRNNSLQTATENTQARVLHAEQEKAKVTEELAAATAQVSHLQLKMTAHQKKETELQMQLTESLKETDLLRGQLTKVQAKLSELQETSEQAQSKFKSEKQNRKQLELKVTSLEEELTDLRVEKESLEKNLSERKKKSAQERSQAEEEIDEIRKSYQEELDKLRQLLKKTRVSTDQAAAEQLSLVQAELQTQWEAKCEHLLASAKDEHLQQYQEVCAQRDAYQQKLVQLQEKCLALQAQITALTKQNEQHIKELEKNKSQMSGVEAAASDPSEKVKKIMNQVFQSLRREFELEESYNGRTILGTIMNTIKMVTLQLLNQQEQEKEESSSEEEEEKAEERPRRPSQEQSASASSGQPQAPLNRERPESPMVPSEQVVEEAVPLPPQALTTSQDGHRRKGDSEAEALSEIKDGSLPPELSCIPSHRVLGPPTSIPPEPLGPVSMDSECEESLAASPMAAKPDNPSGKVCVREVAPDGPLQESSTRLSLTSDPEEGDPLALGPESPGEPQPPQLKKDDVTSSTGPHKELSSTEAGSTVAGAALRPSHHSQRSSLSGDEEDELFKGATLKALRPKAQPEEEDEDEVSMKGRPPPTPLFGDDDDDDDIDWLG

SEQ ID NO: 860 - protein, 413 aa, Human
MASCAEPSEPSAPLPAGVPPLEDFEVLDGVEDAEGEEEEEEEEEEEDDLSELPPLEDMGQPPAEEAEQPGALAREFLAAMEPEPAPAPAPEEWLDILGNGLLRKKTLVPGPPGSSRPVKGQVVTVHLQTSLENGTRVQEEPELVFTLGDCDVIQALDLSVPLMDVGETAMVTADSKYCYGPQGSRSPYIPPHAALCLEVTLKTAVDGPDLEMLTGQERVALANRKRECGNAHYQRADFVLAANSYDLAIKAITSSAKVDMTFEEEAQLLQLKVKCLNNLAASQLKLDHYRAALRSCSLVLEHQPDNIKALFRKGKVLAQQGEYSEAIPILRAALKLEPSNKTIHAELSKLVKKHAAQRSTETALYRKMLGNPSRLPAKCPGKGAWSIPWKWLFGATAVALGGVALSVVIAARN

SEQ ID NO: 861 - protein, 572 aa, Human
MAELVQGQSAPVGMKAEGFVDALHRVRQIAAKIDSIPHLNNSTPLVDPSVYGYGVQKRPLDDGVGNQLGALVHQRTVITEEFKVPDKMVGFIIGRGGEQISRIQAESGCKIQIASESSGIPERPCVLTGTPESIEQAKRLLGQIVDRCRNGPGFHNDIDSNSTIQEILIPASKVGLVIGRGGETIKQLQERTGVKMVMIQDGPLPTGADKPLRITGDAFKVQQAREMVLEIIREKDQADFRGVRGDFNSRMGGGSIEVSVPRFAVGIVIGRNGEMIKKIQNDAGVRIQFKPDDGISPERAAQVMGPPDRCQHAAHIISELILTAQERDGFGGLAAARGRGRGRGDWSVGAPGGVQEITYTVPADKCGLVIGKGGENIKSINQQSGAHVELQRNPPPNSDPNLRRFTIRGVPQQIEVARQLIDEKVGGTNLGAPGAFGQSPFSQPPAPPHQNTFPPRSSGCFPNMAAKVNGNPHSTPVSGPPAFLTQGWGSTYQAWQQPTQQVPSQQSQPQSSQPNYSKAWEDYYKKQSHAASAAPQASSPPDYTMAWAEYYRQQVAFYGQTLGQAQAHSQEQ

SEQ ID NO: 862 - protein, 103 aa, Human
MERQQQQQQQLRNLRDFLLVYNRMTELCFQRCVPSLHHRALDAEEEACLHSCAGKLIHSNHRLMAAYVQLMPALVQRRIADYEAASAVPGVAAEQPGVSPSGS

SEQ ID NO: 863 - protein, 161 aa, Human
MKQVPTLKIDGITIHQSLAIIEYLEEMRPTPRLLPQDPKKRASVRMISDLIAGGIQPLQNLSVLKQVGEEMQLTWAQNAITCGFNALEQILQSTAGIYCVGDEVTMADLCLVPQVANAERFKVDLTPYPTISSINKRLLVLEAFQVSHPCRQPDTPTELRA

SEQ ID NO: 864 - protein, 128 aa, Human
MAGGKAGKDSGKAKAKAVSRSQRAGLQFPVGRIHRHLKTRTTSHGRVGATAAVYSAAILEYLTAEVLELAGNASKDLKVKRITPRHLQLAIRGDEELDSLIKATIAGGGVIPHIHKSLIGKKGQQKTA

SEQ ID NO: 865 - protein, 320 aa, Human
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFGGNDNFGRGGNFSGRGGFGGSRGGGGYGGSGDGYNGFGNDGSNFGGGGSYNDFGNYNNQSSNFGPMKGGNFGGRSSGPYGGGGQYFAKPRNQGGYGGSSSSSSYGSGRRF

SEQ ID NO: 866 - protein, 537 aa, Human
MLARETYEEDREYESQAKRLKTEEGEIDYSAEEGENRREATPRGGGDGGGGGRSFSQPEAGGSHHKVSVSPVVHVRGLCESVVEADLVEALEKFGTICYVMMMPFKRQALVEFENIDSAKECVTFAADEPVYIAGQQAFFNYSTSKRITRPGNTDDPSGGNKVLLLSIQNPLYPITVDVLYTVCNPVGKVQRIVIFKRNGIQAMVEFESVLCAQKAKAALNGADIYAGCCTLKIEYARPTRLNVIRNDNDSWDYTKPYLGRRDRGKGRQRQAILGEHPSSFRHDGYGSHGPLLPLPSRYRMGSRDTPELVAYPLPQASSSYMHGGNPSGSVVMVSGLHQLKMNCSRVFNLFCLYGNIEKVKFMKTIPGTALVEMGDEYAVERAVTHLNNVKLFGKRLNVCVSKQHSVVPSQIFELEDGTSSYKDFAMSKNNRFTSAGQASKNIIQPPSCVLHYYNVPLCVTEETFTKLCNDHEVLTFIKYKVFDAKPSAKTLSGLLEWECKTDAVEALTALNHYQIRVPNGSNPYTLKLCFSTSSHL

SEQ ID NO: 867 - protein, 74 aa, Human
MDVRGPEAPGGRALRDAAENLFQELQEHFQALTATLNLRMEEMGNRIEDLQKNVKDLMVQAGIENSIKEQMLKT

SEQ ID NO: 868 - protein, 646 aa, Human
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGKTVTNAVVTVPAYFNDSQRQATKDAGTIAGLNVLRIINEPTAAAIAYGLDKKVGAERNVLIFDLGGGTFDVSILTIEDGIFEVKSTAGDTHLGGEDFDNRMVNHFIAEFKRKHKKDISENKRAVRRLRTACERAKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYGAAVQAAILSGDKSENVQDLLLLDVTPLSLGIETAGGVMTVLIKRNTTIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKELEKVCNPIITKLYQSAGGMPGGMPGGFPGGGAPPSGGASSGPTIEEVD

SEQ ID NO: 869 - protein, 260 aa, Human
MSLQKTPPTRVFVELVPWADRSRENNLASGRETLPGLRHPLSSTQAQTATREVQVSGTSEVSAGPDRAQVVVRVSSTKEAAAEAKKSVCRRLDYITQSLQQQGVQAENITVTKDFRRVENAYHMEAEVCITFTEFGKMQNICNFLVEKLDSSVVISPPQFYHTPGSVENLRRQACLVAVENAWRKAQEVCNLVGQTLGKPLLIKEEETKEWEGQIDDHQSSRLSSSLTVQQKIKSATIHAASKVFITFEVKGKEKRKKHL

SEQ ID NO: 870 - protein, 625 aa, Human
MLTQAAVRLVRGSLRKTSWAEWGHRELRLGQLAPFTAPHKDKSFSDQRSELKRRLKAEKKVAEKEAKQKELSEKQLSQATAAATNHTTDNGVGPEEESVDPNQYYKIRSQAIHQLKVNGEDPYPHKFHVDISLTDFIQKYSHLQPGDHLTDITLKVAGRIHAKRASGGKLIFYDLRGEGVKLQVMANSRNYKSEEEFIHINNKLRRGDIIGVQGNPGKTKKGELSIIPYEITLLSPCLHMLPHLHFGLKDKETRYRQRYLDLILNDFVRQKFIIRSKIITYIRSFLDELGFLEIETPMMNIIPGGAVAKPFITYHNELDMNLYMRIAPELYHKMLVVGGIDRVYEIGRQFRNEGIDLTHNPEFTTCEFYMAYADYHDLMEITEKMVSGMVKHITGSYKVTYHPDGPEGQAYDVDFTPPFRRINMVEELEKALGMKLPETNLFETEETRKILDDICVAKAVECPPPRTTARLLDKLVGEFLEVTCINPTFICDHPQIMSPLAKWHRSKEGLTERFELFVMKKEICNAYTELNDPMRQRQLFEEQAKAKAAGDDEAMFIDENFCTALEYGLPPTAGWGMGIDRVAMFLTDSNNIKEVLLFPAMKPEDKKENVATTDTLESTTVGTSV

SEQ ID NO: 871 - protein, 499 aa, Human
MVDRGPLLTSAIIFYLAIGAAIFEVLEEPHWKEAKKNYYTQKLHLLKEFPCLGQEGLDKILEVVSDAAGQGVAITGNQTFNNWNWPNAMIFAATVITTIGYGNVAPKTPAGRLFCVFYGLFGVPLCLTWISALGKFFGGRAKRLGQFLTKRGVSLRKAQITCTVIFIVWGVLVHLVIPPFVFMVTEGWNYIEGLYYSFITISTIGFGDFVAGVNPSANYHALYRYFVELWIYLGLAWLSLFVNWKVSMFVEVHKAIKKRRRRRKESFESSPHSRKALQVKGSTASKDVNIFSFLSKKEETYNDLIKQIGKKAMKTSGGGETGPGPGLGPQGGGLPALPPSLVPLVVYSKNRVPTLEEVSQTLRSKGHVSRSPDEEAVARAPEDSSPAPEVFMNQLDRISEECEPWDAQDYHPLIFQDASITFVNTEAGLSDEETSKSSLEDNLAGEESPQQGAEAKAPLNMGEFPSSSESTFTSTESELSVPYEQLMNEYNKANSPKGT

SEQ ID NO: 872 - protein, 392 aa, Human
MATAAQGPLSLLWGWLWSERFWLPENVSWADLEGPADGYGYPRGRHILSVFPLAAGIFFVRLLFERFIAKPCALCIGIEDSGPYQAQPNAILEKVFISITKYPDKKRLEGLSKQLDWNVRKIQCWFRHRRNQDKPPTLTKFCESMWRFTFYLCIFCYGIRFLWSSPWFWDIRQCWHNYPFQPLSSGLYHYYIMELAFYWSLMFSQFTDIKRKDFLIMFVHHLVTIGLISFSYINNMVRVGTLIMCLHDVSDFLLEAAKLANYAKYQRLCDTLFVIFSAVFMVTRLGIYPFWILNTTLFESWEIIGPYASWWLLNGLLLTLQLLHVIWSYLIARIALKALIRGKVSKDDRSDVESSSEEEDVTTCTKSPCDSSSSNGANRVNGHMGGSYWAEE

SEQ ID NO: 873 - protein, 1076 aa, Human
MEPGSKSVSRSDWQPEPHQRPITPLEPGPEKTPIAQPESKTLQGSNTQQKPASNQRPLTQQETPAQHDAESQKEPRAQQKSASQEEFLAPQKPAPQQSPYIQRVLLTQQEAASQQGPGLGKESITQQEPALRQRHVAQPGPGPGEPPPAQQEAESTPAAQAKPGAKREPSAPTESTSQETPEQSDKQTTPVQGAKSKQGSLTELGFLTKLQELSIQRSALEWKALSEWVTDSESESDVGSSSDTDSPATMGGMVAQGVKLGFKGKSGYKVMSGYSGTSPHEKTSARNHRHYQDTASRLIHNMDLRTMTQSLVTLAEDNIAFFSSQGPGETAQRLSGVFAGVREQALGLEPALGRLLGVAHLFDLDPETPANGYRSLVHTARCCLAHLLHKSRYVASNRRSIFFRTSHNLAELEAYLAALTQLRALVYYAQRLLVTNRPGVLFFEGDEGLTADFLREYVTLHKGCFYGRCLGFQFTPAIRPFLQTISIGLVSFGEHYKRNETGLSVAASSLFTSGRFAIDPELRGAEFERITQNLDVHFWKAFWNITEMEVLSSLANMASATVRVSRLLSLPPEAFEMPLTADPTLTVTISPPLAHTGPGPVLVRLISYDLREGQDSEELSSLIKSNGQRSLELWPRPQQAPRSRSLIVHFHGGGFVAQTSRSHEPYLKSWAQELGAPIISIDYSLAPEAPFPRALEECFFAYCWAIKHCALLGSTGERICLAGDSAGGNLCFTVALRAAAYGVRVPDGIMAAYPATMLQPAASPSRLLSLMDPLLPLSVLSKCVSAYAGAKTEDHSNSDQKALGMMGLVRRDTALLLRDFRLGASSWLNSFLELSGRKSQKMSEPIAEPMRRSVSEAALAQPQGPLGTDSLKNLTLRDLSLRGNSETSSDTPEMSLSAETLSPSTPSDVNFLLPPEDAGEEAEAKNELSPMDRGLGVRAAFPEGFHPRRSSQGATQMPLYSSPIVKNPFMSPLLAPDSMLKSLPPVHIVACALDPMLDDSVMLARRLRNLGQPVTLRVVEDLPHGFLTLAALCRETRQAAELCVERIRLVLTPPAGAGPSGETGAAGVDGGCGGRH

SEQ ID NO: 874 - protein, 168 aa, Human
GGGACSSEAGSGPQPAGGAGGEMLASAPSSPRILPWKKPAPTAGLTEDGFKALRKTAFPFARLSFSLLLPCEEVTSAIIEEEDRALTRGRQRWHSKRHAPRMPPMPQDRPTHGTRLSGPGRMGWNLRGEPSSPGWKWATRDWHLYILSPKPSIYVVSKERNHVTSSKK

SEQ ID NO: 875 - protein, 69 aa, Human
CEEVTSAIIEEEDRALTRGRQRWHSKRHAPRMPPMPQDRPTHGTRLSGPGRMGWNLRGEPSSPGWKWAT

SEQ ID NO: 876 - protein, 463 aa, Human
MSGGTPYIGSKISLISKAEIRYEGILYTIDTENSTVALAKVRSFGTEDRPTDRPIPPRDEVFEYIIFRGSDIKDLTVCEPPKPQCSLPQDPAIVQSSLGSSTSSFQSMGSYGPFGRMPTYSQFSPSSLVGQQFGAVGVAGSSLTSFGTETSNSGTLPQSSAVGSAFTQDTRSLKTQLSQGRSSPQLDPLRKSPTMEQAVQTASAHLPAPAAVGRRSPVSTRPLPSASQKAGENQEHRRAEVHKVSRPENEQLRNDNKRQVAPGAPSAPRRGRGGHRGGRGRFGIRRDGPMKFEKDFDFESANAQFNKEEIDREFHNKLKLKEDKLEKQEKPVNGEDKGDSGVDTQNSEGNADEEDPLGPNCYYDKTKSFFDNISCDDNRERRPTWAEERRLNAETFGIPLRPNRGRGGYRGRGGLGFRGGRGRGGGRGGTFTAPRGFRGGFRGGRGGREFADFEYRKTTAFGP

SEQ ID NO: 877 - protein, 385 aa, Human
MSGSSGTPYLGSKISLISKAQIRYEGILYTIDTDNSTVALAKVRSFGTEDRPTDRPAPPREEIYEYIIFRGSDIKDITVCEPPKAQHTLPQDPAIVQSSLGSASASPFQPHVPYSPFRGMAPYGPLAASSLLSQQYAASLGLGAGFPSIPVGKSPMVEQAVQTGSADNLNAKKLLPGKGTTGTQLNGRQAQPSSKTASDVVQPAAVQAQGQVNDENRRPQRRRSGNRRTRNRSRGQNRPTNVKENTIKFEGDFDFESANAQFNREELDKEFKKKLNFKDDKAEKGEEKDLAVVTQSAEAPAEEDLLGPNCYYDKSKSFFDNISSELKTSSRRTTWAEERKLNTETFGVSGRFLRGRSSRGGFRGGRGNGTTRRNPTSHRAGTGRV

SEQ ID NO: 878 - protein, 630 aa, Human
MQQDGLGVGTRNGSGKGRSVHPSWPWCAPRPLRYFGRDARARRAQTAAMALLAGGLSRGLGSHPAAAGRDAVVFVWLLLSTWCTAPARAIQVTVSNPYHVVILFQPVTLPCTYQMTSTPTQPIVIWKYKSFCRDRIADAFSPASVDNQLNAQLAAGNPGYNPYVECQDSVRTVRVVATKQGNAVTLGDYYQGRRITITGNADLTFDQTAWGDSGVYYCSVVSAQDLQGNNEAYAELIVLDWLFVVVVCLAAFLIFLLLGICWCQCCPHTCCCYVRCPCCPDKCCCPEALYAAGKAATSGVPSIYAPSTYAHLSPAKTPPPPAMIPMGPAYNGYPGGYPGDVDRSSSAGGQGSYVPLLRDTDSSVASEVRSGYRIQASQQDDSMRVLYYMEKELANFDPSRPGPPSGRVERAMSEVTSLHEDDWRSRPSRGPALTPIRDEEWGGHSPRSPRGWDQEPAREQAGGGWRARRPRARSVDALDDLTPPSTAESGSRSPTSNGGRSRAYMPPRSRSRDDLYDQDDSRDFPRSRDPHYDDFRSRERPPADPRSHHHRTRDPRDNGSRSGDLPYDGRLLEEAVRKKGSEERRRPHKEEEEEAYYPPAPPPYSETDSQASRERRLKKNLALSRESLVV

SEQ ID NO: 879 - protein, 458 aa, Human
MAALGSPSHTFRGLLRELRYLSAATGRPYRDTAAYRYLVKAFRAHRVTSEKLCRAQHELHFQAATYLCLLRSIRKHVALHQEFHGKGDTTRQRIKFSDDRVCKSHLLNCCPHDVLSGTRMDLGECLKVHDLALRADYEIASKEQDFFFELDAMDHLQSFIADCDRRTEVAKKRLAETQEEISAEVAAKAERVHELNEEIGKLLAKVEQLGAEGNVEESQKVMDEVEKARAKKREAEEVYRNSMPASSFQQQKLRVCEVCSAYLGLHDNDRRLADHFGGKLHLGFIEIREKLEELKRVVAEKQEKRNQERLKRREEREREEREKLRRSRSHSKNPKRSRSREHRRHRSRSMSRERKRRTRSKSREKRHRHRSRSSSRSRSRSHQRSRHSSRDRSRERSKRRSSKERFRDQDLASCDRDRSSRDRSPRDRDRKDKKRSYESANGRSEDRRSSEEREAGEI

SEQ ID NO: 880 - protein, 527 aa, Human
MENQEKASIAGHMFDVVVIGGGISGLSAAKLLTEYGVSVLVLEARDRVGGRTYTIRNEHVDYVDVGGAYVGPTQNRILRLSKELGIETYKVNVSERLVQYVKGKTYPFRGAFPPVWNPIAYLDYNNLWRTIDNMGKEIPTDAPWEAQHADKWDKMTMKELIDKICWTKTARRFAYLFVNINVTSEPHEVSALWFLWYVKQCGGTTRIFSVTNGGQERKFVGGSGQVSERIMDLLGDQVKLNHPVTHVDQSSDNIIIETLNHEHYECKYVINAIPPTLTAKIHFRPELPAERNQLIQRLPMGAVIKCMMYYKEAFWKKKDYCGCMIIEDEDAPISITLDDTKPDGSLPAIMGFILARKADRLAKLHKEIRKKKICELYAKVLGSQEALHPVHYEEKNWCEEQYSGGCYTAYFPPGIMTQYGRVIRQPVGRIFFAGTETATKWSGYMEGAVEAGERAAREVLNGLGKVTEKDIWVQEPESKDVPAVEITHTFWERNLPSVSGLLKIIGFSTSVTALGFVLYKYKLLPRS

SEQ ID NO: 881 - protein, 824 aa, Human
MADRAEMFSLSTFHSLSPPGCRPPQDISLEEFDDEDLSEITDDCGLGLSYDSDHCEKDSLSLGRSEQPHPICSFQDDFQEFEMIDDNEEEDDEDEEEEEEEEEGDGEGQEGGDPGSEAPAPGPLIPSPSVEEPHKHRPTTLRLTTLGAQDSLNNNGGFDLVRPASWQETALCSPAPEALRELPGPLPATDTGPGGAQSPVRPGCDCEGNRPAEPPAPGGTSPSSDPGIEADLRSRSSGGRGGRRSSQELSSPGSDSEDAGGARLGRMISSISETELELSSDGGSSSSGRSSHLTNSIEEASSPASEPEPPREPPRRPAFLPVGPDDTNSEYESGSESEPDLSEDADSPWLLSNLVSRMISEGSSPIRCPGQCLSPAPRPPGEPVSPAGGAAQDSQDPEAAAGPGGVELVDMETLCAPPPPAPAAPRPGPAQPGPCLFLSNPTRDTITPLWAAPGRAARPGRACSAACSEEEDEEDDEEEEDAEDSAGSPGGRGTGPSAPRDASLVYDAVKYTLVVDEHTQLELVSLRRCAGLGHDSEEDSGGEASEEEAGAALLGGGQVSGDTSPDSPDLTFSKKFLNVFVNSTSRSSSTESFGLFSCLVNGEEREQTHRAVFRFIPRHPDELELDVDDPVLVEAEEDDFWFRGFNMRTGERGVFPAFYAHAVPGPAKDLLGSKRSPCWVERFDVQFLGSVEVPCHQGNGILCAAMQKIATARKLTVHLRPPASCDLEISLRGVKLSLSGGGPEFQRCSHFFQMKNISFCGCHPRNSCYFGFITKHPLLSRFACHVFVSQESMRPVAQSVGRAFLEYYQEHLAYACPTEDIYLE

SEQ ID NO: 882 - protein, 291 aa, Human
MERKRWECPALPQGWEREEVPRRSGLSAGHRDVFYYSPSGKKFRSKPQLARYLGGSMDLSTFDFRTGKMLMSKMNKSRQRVRYDSSNQVKGKPDLNTALPVRQTASIFKQPVTKITNHPSNKVKSDPQKAVDQPRQLFWEKKLSGLNAFDIAEELVKTMDLPKGLQGVGPGCTDETLLSAIASALHTSTMPITGQLSAAVEKNPGVWLNTTQPLCKAFMVTDEDIRKQEELVQQVRKRLEEALMADMLAHVEELARDGEAPLDKACAEDDDEEDEEEEEEEPDPDPEMEHV

SEQ ID NO: 883 - protein, 261 aa, Human [sequence omitted]

SEQ ID NO: 884 - protein, 192 aa, Human [sequence omitted]

SEQ ID NO: 885 - protein, 577 aa, Human
MPKTISVRVTTMDAELEFAIQPNTTGKQLFDQVVKTIGLREVWFFGLQYQDTKGFSTWLKLNKKVTAQDVRKESPLLFKFRAKFYPEDVSEELIQDITQRLFFLQVKEGILNDDIYCPPETAVLLASYAVQSKYGDFNKEVHKSGYLAGDKLLPQRVLEQHKLNKDQWEERIQVWHEEHRGMLREDAVLEYLKIAQDLEMYGVNYFSIKNKKGSELWLGVDALGLNIYEQNDRLTPKIGFPWSEIRNISFNDKKFVIKPIDKKAPDFVFYAPRLRINKRILALCMGNHELYMRRRKPDTIEVQQMKAQAREEKHQKQMERAMLENEKKKREMAEKEKEKIEREKEELMERLKQIEEQTKKAQQELEEQTRRALELEQERKRAQSEAEKLAKERQEAEEAKEALLQASRDQKKTQEQLALEMAELTARISQLEMARQKKESEAVEWQQKAQMVQEDLEKTRAELKTAMSTPHVAEPAENEQDEQDENGAEASADLRADAMAKDRSEEERTTEAEKNERVQKHLKALTSELANARDESKKTANDMIHAENMRLGRDKYKTLRQIRQGNTKQRIDEFESM

SEQ ID NO: 886 - protein, 193 aa, Human
MEPLASNIQVLLQAAEFLERREREAEHGYASLCPHRSPGPIHRRKKRPPQAPGAQDSGRSVHNELEKRRRAQLKRCLERLKQQMPLGADCARYTTLSLLRRARMHIQKLEDQEQRARQLKERLRSKQQSLQRQLEQLRGLAGAAERERLRADSLDSSGLSSERSDSDQVLPNENGGTPNHRPTGRGNNISSHH

SEQ ID NO: 887 - protein, 182 aa, Human
MPSPRLQHSKPPRRLSRAQKHSSGSSNTSTANRRAHLRLCLERLKVLIPLGPDCTRHTTLGLLNKAKAHIKKLEEAERKSQHQLENLEREQRFLKWRLEQLQGPQEMERIRMDSIGSTISSDRSDSEREEIEVDVESTEFSHGEVDNISTTSISDIDDHSSLPSIGSDEGYSSASVKLSFTS

SEQ ID NO: 888 - protein, 589 aa, Human
MDLIDILWRQDIDLGVSREVFDFSQRRKEYELEKQKKLEKERQEQLQKEQEKAFFAQLQLDEETGEFLPIQPAQHIQSETSGSANYSQVAHIPKSDALYFDDCMQLLAQTFPFVDDNEVSSATFQSLVPDIPGHIESPVFIATNQAQSPETSVAQVAPVDLDGMQQDIEQVWEELLSIPELQCLNIENDKLVETTMVPSPEAKLTEVDNYHFYSSIPSMEKEVGNCSPHFLNAFEDSFSSILSTEDPNQLTVNSLNSDATVNTDFGDEFYSAFIAEPSISNSMPSPATLSHSLSELLNGPIDVSDLSLCKAFNQNHPESTAEFNDSDSGISLNTSPSVASPEHSVESSSYGDTLLGLSDSEVEELDSAPGSVKQNGPKTPVHSSGDMVQPLSPSQGQSTHVHDAQCENTPEKELPVSPGHRKTPFTKDKHSSRLEAHLTRDELRAKALHIPFPVEKIINLPVVDFNEMMSKEQFNEAQLALIRDIRRRGKNKVAAQNCRKRKLENIVELEQDLDHLKDEKEKLLKEKGENDKSLHLLKKQLSTLYLEVFSMLRDEDGKPYSPSEYSLQQTRDGNVFLVPKSKKPDVKKN

SEQ ID NO: 889 - protein, 1606 aa, Human
MVVFINAKIKSLIKLFKKKTVSNLDEESRWTVHYTAPWHQQENVFLPTTRPPCVEDLHRQAKLNLKSVLRECDKLRHDGYRSSQYYSQGPTFAANASPFCDDYQDEDEETDQKCSLSSSEEERFISIRRPKTPASSDFSDLNTQTNWTKSLPLPTPEEKMRQQAQTVQADVVPINITGENFDRQASLRRSLIYTDTLVRRPKKVKRRKTITGVPDNIQKELASGTGQDDADGHSVYTPDHYSTLGRFNSCRSAGQRSETRDSSCQTEDVKVVPPSMRRIRAQKGQGIAAQMGHFSGSSGNMSVLSDSAGIVFPSRLDSDAGFHSLPRSGARANIQSLEPRLGALGPAGDMNGTFLYQRGHPQADENLGHLGGASGTGTLLRPKSQELRHFESENIMSPACVVSPHATYSTSIIPNATLSSSSEVIAIPTAQSAGQRESKSSGSSHARIKSRDHLISRHAVKGDPQSPGRHWNEGHATILSQDLDPHSPGEPALLSLCDSAVPLNAPANRENGSQAMPYNCRNNLAFPAHPQDVDGKSESSYSGGGGHSSSEPWEYKSSGNGRASPLKPHLATPGYSTPTSNMSSCSLDQTSNKEDAGSLYSEDHDGYCASVHTDSGHGSGNLCNSSDGFGNPRHSVINVFVGRAQKNQGDRSNYQDKSLSRNISLKKAKKPPLPPSRTDSLRRIPKKSSQCNGQVLNESLIATLQHSLQLSLPGKSGSSPSQSPCSDLEEPWLPRSRSQSTVSAGSSMTSATTPNVYSLCGATPSQSDTSSVKSEYTDPWGYYIDYTGMQEDPGNPAGGCSTSSGVPTGNGPVRHVQEGSRATMPQVPGGSVKPKIMSPEKSHRVISPSSGYSSQSNTPTALTPVPVFLKSVSPANGKGKPKPKVPERKSSLISSVSISSSSTSLSSSTSTEGSGTMKKLDPAVGSPPAPPPPPVPSPPFPCPADRSPFLPPPPPVTDCSQGSPLPHSPVFPPPPPEALIPFCSPPDWCLSPPRPALSPILPDSPVSLPLPPPLLPSSEPPPAPPLDPKFMKDTRPPFTNSGQPESSRGSLRPPSTKEETSRPPMPLITTEALQMVQLRPVRKNSGAEAAQLSERTAQEQRTPVAPQYHLKPSAFLKSRNSTNEMESESQPASVTSSLPTPAKSSSQGDHGSAAERGGPVSRSPGAPSAGEAEARPSPSTTPLPDSSPSRKPPPISKKPKLFLVVPPPQKDFAVEPAENVSEALRAVPSPTTGEEGSVHSREAKESSAAQAGSHATHPGTSVLEGGAAGSMSPSRVEANVPMVQPDVSPAPKQEEPAENSADTGGDGESCLSQQDGAAGVPETNAAGSSSEACDFLKEDGNDEVMTPSRPRTTEDLFAAIHRSKRKVLGRRDSDDDHSRNHSPSPPVTPTGAAPSLASPKQVGSIQRSIRKSSTSSDNFKALLLKKGSRSDTSARMSAAEMLKNTDPRFQRSRSEPSPDAPESPSSCSPSKNRRAQEEWAKNEGLMPRSLSFSGPRYGRSRTPPSAASSRYSMRNRIQSSPMTVISEGEGEAVEPVDSIARGALGAAEGCSLDGLAREEMDEGGLLCGEGPAASLQPQAPGPVDGTASAEGREPSPQCGGSLSEES

SEQ ID NO: 890 - protein, 81 aa, Human
MAAVAAASAELLIIGWYIFRVLLQVFLECCIYWVGFAFRNPPGTQPIARSEVFRYSLQKLAYTVSRTGRQVLGERRQRAPN

SEQ ID NO: 891 - protein, 535 aa, Human
MSEGESQTVLSSGSDPKVESSSSAPGLTSVSPPVTSTTSAASPEEEEESEDESEILEESPCGRWQKRREEVNQRNVPGIDSAYLAMDTEEGVEVVWNEVQFSERKNYKLQEEKVRAVFDNLIQLEHLNIVKFHKYWADIKENKARVIFITEYMSSGSLKQFLKKTKKNHKTMNEKAWKRWCTQILSALSYLHSCDPPIIHGNLTCDTIFIQHNGLIKIGSVAPDTINNHVKTCREEQKNLHFFAPEYGEVTNVTTAVDIYSFGMCALEMAVLEIQGNGESSYVPQEAISSAIQLLEDPLQREFIQKCLQSEPARRPTARELLFHPALFEVPSLKLLAAHCIVGHQHMIPENALEEITKNMDTSAVLAEIPAGPGREPVQTLYSQSPALELDKFLEDVRNGIYPLTAFGLPRPQQPQQEEVTSPVVPPSVKTPTPEPAEVETRKVVLMQCNIESVEEGVKHHLTLLLKLEDKLNRHLSCDLMPNENIPELAAELVQLGFISEADQSRLTSLLEETLNKFNFARNSTLNSAAVTVSS

SEQ ID NO: 892 - protein, 326 aa, Human
MAAFAVEPQGPALGSEPMMLGSPTSPKPGVNAQFLPGFLMGDLPAPVTPQPRSISGPSVGVMEMRSPLLAGGSPPQPVVPAHKDKSGAPPVRSIYDDISSPGLGSTPLTSRRQPNISVMQSPLVGVTSTPGTGQSMFSPASIGQPRKTTLSPAQLDPFYTQGDSLTSEDHLDDSWVTVFGFPQASASYILLQFAQYGNILKHVMSNTGNWMHIRYQSKLQARKALSKDGRIFGESIMIGVKPCIDKSVMESSDRCALSSPSLAFTPPIKTLGTPTQPGSTPRISTMRPLATAYKASTSDYQVISDRQTPKKDESLVSKAMEYMFGW

SEQ ID NO: 893 - protein, 252 aa, Human
MGSELIGRLAPRLGLAEPDMLRKAEEYLRLSRVKCVGLSARTTETSSAVMCLDLAASWMKCPLDRAYLIKLSGLNKETYQSCLKSFECLLGLNSNIGIRDLAVQFSCIEAVNMASKILKSYESSLPQTQQVDLDLSRPLFTSAALLSACKILKLKVDKNKMVATSGVKKAIFDRLCKQLEKIGQQVDREPGDVATPPRKRKKIVVEAPAKEMEKVEEMPHKPQKDEDLTQDYEEWKRKILENAASAQKATAE

SEQ ID NO: 894 - protein, 773 aa, Human
MAECGASGSGSSGDSLDKSITLPPDEIFRNLENAKRFAIDIGGSLTKLAYYSTVQHKVAKVRSFDHSGKDTEREHEPPYEISVQEEITARLHFIKFENTYIEACLDFIKDHLVNTETKVIQATGGGAYKFKDLIEEKLRLKVDKEDVMTCLIKGCNFVLKNIPHEAFVYQKDSDPEFRFQTNHPHIFPYLLVNIGSGVSIVKVETEDRFEWVGGSSIGGGTFWGLGALLTKTKKFDELLHLASRGQHSNVDMLVRDVYGGAHQTLGLSGNLIASSFGKSATADQEFSKEDMAKSLLHMISNDIGQLACLHARLHSLDRVYFGGFFIRGHPVTMRTITYSINFFSKGEVQALFLRHEGYLGAIGAFLKGAEQDNPNQYSWGENYAGSSGLMSASPELGPAQRARSGTFDLLEMDRLERPLVDLPLLLDPPSYVPDTVDLTDDALARKYWLTCFEEALDGVVKRAVASQPDSVDAAERAEKFRQKYWNKLQTLRQQPFAYGTLTVRSLLDTREHCLNEFNFPDPYSKVKQRENGVALRCFPGVVRSLDALGWEERQLALVKGLLAGNVFDWGAKAVSAVLESDPYFGFEEAKRKLQERPWLVDSYSEWLQRLKGPPHKCALIFADNSGIDIILGVFPFVRELLLRGTEVILACNSGPALNDVTHSESLIVAERIAGMDPVVHSALQEERLLLVQTGSSSPCLDLSRLDKGLAALVRERGADLVVIEGMGRAVHTNYHAALRCESLKLAVIKNAWLAERLGGRLFSVIFKYEVPAE

SEQ ID NO: 895 - protein, 731 aa, Human
MASCPDSDNSWVLAGSESLPVETLGPASRMDPESERALQAPHSPSKTDGKELAGTMDGEGTLFQTESPQSGSILTEETEVKGTLEGDVCGVEPPGPGDTVVQGDLQETTVVTGLGPDTQDLEGQSPPQSLPSTPKAAWIREEGRCSSSDDDTDVDMEGLRRRRGREAGPPQPMVPLAVENQAGGEGAGGELGISLNMCLLGALVLLGLGVLLFSGGLSESETGPMEEVERQVLPDPEVLEAVGDRQDGLREQLQAPVPPDSVPSLQNMGLLLDKLAKENQDIRLLQAQLQAQKEELQSLMHQPKGLEEENAQLRGALQQGEAFQRALESELQQLRARLQGLEADCVRGPDGVCLSGGRGPQGDKAIREQGPREQEPELSFLKQKEQLEAEAQALRQELERQRRLLGSVQQDLERSLQDASRGDPAHAGLAELGHRLAQKLQGLENWGQDPGVSANASKAWHQKSHFQNSREWSGKEKWWDGQRDRKAEHWKHKKEESGRERKKNWGGQEDREPAGRWKEGRPRVEESGSKKEGKRQGPKEPPRKSGSFHSSGEKQKQPRWREGTKDSHDPLPSWAELLRPKYRAPQGCSGVDECARQEGLTFFGTELAPVRQQELASLLRTYLARLPWAGQLTKELPLSPAFFGEDGIFRHDRLRFRDFVDALEDSLEEVAVQQTGDDDEVDDFEDFIFSHFFGDKALKKRSGKKDKHSQSPRAAGPREGHSHSHHHHHRG

SEQ ID NO: 896 - protein, 403 aa, Human
MSGSDGGLEEEPELSITLTLRMLMHGKEVGSIIGKKGETVKRIREQSSARITISEGSCPERITTITGSTAAVFHAVSMIAFKLDEDLCAAPANGGNVSRPPVTLRLVIPASQCGSLIGKAGTKIKEIRETTGAQVQVAGDLLPNSTERAVTVSGVPDAIILCVRQICAVILESPPKGATIPYHPSLSLGTVLLSANQGFSVQGQYGAVTPAEVTKLQQLSSHAVPFATPSVVPGLDPGTQTSSQEFLVPNDLIGCVIGRQGSKISEIRQMSGAHIKIGNQAEGAGERHVTITGSPVSIALAQYLITACLETAKSTSGGTPSSAPADLPAPFSPPLTALPTAPPGLLGTPYAISLSNFIGLKPMPFLALPPASPGPPPGLAAYTAKMAAANGSKKAERQKFSPY

SEQ ID NO: 897 - protein, 120 aa, Human
MAAQRLGKRVLSKLQSPSRARGPGGSPGGLQKRHARVTVKYDRRELQRRLDVEKWIDGRLEELYRGMGLLKSCGKPVEDFIQELLAKLQGLHRQPGLRQPSPSHDGSLSPLQDRARTAHP

SEQ ID NO: 898 - protein, 689 aa, Human
MEDTGIQRGIWDGDAKAVQQCLTDIFTSVYTTCDIPENAIFGPCVLSHTSLYDSIAFIALKSTDKRTVPYIFRVDTSAANGSSEGLMWLRLVQSARDKEEQNLEAYIKNGQLFYRSLRRIAKDEELLVWYGKELTELLLLCPSRSHNKMNGSSPYTCLECSQRFQFEFPYVAHLRFRCPKRLHSADISPQDEQGGGVGTKDHGGGGGGGKDQQQQQQEAPLGPGPKFCKAGPLHHYPSPSPESSNPSAAAGGSSAKPSTDFHNLARELENSRGGSSCSPAQSLSSGSGSGGGGGHQEAELSPDGIATGGGKGKRKFPEEAAEGGGGAGLVGGRGRFVERPLPASKEDLVCTPQQYRASGSYFGLEENGRLFAPPSPETGEAKRSAFVEVKKAARAASLQEEGTADGAGVASEDQDAGGGGGSSTPAAASPVGAEKLLAPRPGGPLPSRLEGGSPARGSAFTSVPQLGSAGSTSGGGGTGAGAAGGAGGGQGAASDERKSAFSQPARSFSQLSPLVLGQKLGALEPCHPADGVGPTRLYPAAADPLAVKLQGAADLNGGCGSLPSGGGGLPKQSPFLYATAFWPKSSAAAAAAAAAAAAGPLQLQLPSALTLLPPSFTSLCLPAQNWCAKCNASFRMTSDLVYHMRSHHKKEYAMEPLVKRRREEKLKCPICNESFRERHHLSRHMTSHN

SEQ ID NO: 899 - protein, 168 aa, Human
MQAQQYQQQRRKFAAAFLAFIFILAAVDTAEAGKKEKPEKKVKKSDCGEWQWSVCVPTSGDCGLGTREGTRTGAECKQTMKTQRCKIPCNWKKQFGAECKYQFQAWGECDLNTALKTRTGSLKRALHNAECQKTVTISKPCGKLTKPKPQAESKKKKKEGKKQEKMLD

SEQ ID NO: 900 - protein, 317 aa, Human
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILSDVQLIKTGDKVGASEATLLNMLNISPFSFGLVIQQVFDNGSIYNPEVLDITEETLHSRFLEGVRNVASVCLQIGYPTVASVPHSIINGYKRVLALSVETDYTFPLAEKVKAFLADPSAFVAAAPVAAATTAAPAAAAAPAKVEAKEESEESDEDMGFGLFD

SEQ ID NO: 901 - protein, 243 aa, Human
MAVQISKKRKFVADGIFKAELNEFLTRELAEDGYSGVEVRVTPTRTEIIILATRTQNVLGEKGRRIRELTAVVQKRFGFPEGSVELYAEKVATRGLCAIAQAESLRYKLLGGLAVRRACYGVLRFIMESGAKGCEVVVSGKLRGQRAKSMKFVDGLMIHSGDPVNYYVDTAVRHVLLRQGVLGIKVKIMLPWDPTGKIGPKKPLPDHVSIVEPKDEILPTTPISEQKGGKPEPPAMPQPVPTA

SEQ ID NO: 902 - protein, 335 aa, Human
MGRCCFYTAGTLSLLLLVTSVTLLVARVFQKAVDQSIEKKIVLRNGTEAFDSWEKPPLPVYTQFYFFNVTNPEEILRGETPRVEEVGPYTYRSLDWWITDKCNMINGTDGDSFHPLITKDEVLYVFPSDFCRSVYITFSDYESVQGLPAFRYKVPAEILANTSDNAGFCIPEGNCLGSGVLNVSICKNGAPIIMSFPHFYQADERFVSAIEGMHPNQEDHETFVDINPLTGIILKAAKRFQINIYVKKLDDFVETGDIRTMVFPVMYLNESVHIDKETASRLKSMINTTLIITNIPYIIMALGVFFGLVFTWLACKGQGSMDEGTADERAPLIRT

SEQ ID NO: 903 - protein, 713 aa, Human
MAKSPENSTLEEILGQYQRSLREHASRSIHQLTCALKEGDVTIGEDAPNLSFSTSVGNEDARTAWPELQQSHAVNQLKDLLRQQADKESEVSPSRRRKMSPLRSLEHEETNMPTMHDLVHTINDQSQYIHHLEAEVKFCKEELSGMKNKIQVVVLENEGLQQQLKSQRQEETLREQTLLDASGNMHNSWITTGEDSGVGETSKRPFSHDNADFGKAASAGEQLELEKLKLTYEEKCEIEESQLKFLRNDLAEYQRTCEDLKEQLKHKEFLLAANTCNRVGGLCLKCAQHEAVLSQTHTNVHMQTIERLVKERDDLMSALVSVRSSLADTQQREASAYEQVKQVLQISEEANFEKTKALIQCDQLRKELERQAERLEKELASQQEKRAIEKDMMKKEITKEREYMGSKMLILSQNIAQLEAQVEKVTKEKISAINQLEEIQSQLASREMDVTKVCGEMRYQLNKTNMEKDEAEKEHREFRAKTNRDLEIKDQEIEKLRIELDESKQHLEQEQQKAALAREECLRLTELLGESEHQLHLTRQEKDSIQQSFSKEAKAQALQAQQREQELTQKIQQMEAQHDKTENEQYLLLTSQNTFLTKLKEECCTLAKKLEQISQKTRSEIAQLSQEKRYTYDKLGKLQRRNEELEEQCVQHGRVHETMKQRLRQLDKHSQATAQQLVQLLSKQNQLLLERQSLSEEVDRLRTQLPSMPQSDC

SEQ ID NO: 904 - protein, 293 aa, Human
MRVLVGGGTGFIGTALTQLLNARGHEVTLVSRKPGPGRITWDELAASGLPSCDAAVNLAGENILNPLRRWNETFQKEVIGSRLETTQLLAKAITKAPQPPKAWVLVTGVAYYQPSLTAEYDEDSPGGDFDFFSNLVTKWEAAARLPGDSTRQVVVRSGVVLGRGGGAMGHMLLPFRLGLGGPIGSGHQFFPWIHIGDLAGILTHALEANHVHGVLNGVAPSSATNAEFAQTLGAALGRRAFIPLPSAVVQAVFGRQRAIMLLEGQKVIPQRTLATGYQYSFPELGAALKEIVA

SEQ ID NO: 905 - protein, 328 aa, Human
MMSGEPLHVKTPIRDSMALSKMAGTSVYLKMDSAQPSGSFKIRGIGHFCKRWAKQGCAHFVCSSAGNAGMAAAYAARQLGVPATIVVPSTTPALTIERLKNEGATVKVVGELLDEAFELAKALAKNNPGWVYIPPFDDPLIWEGHASIVKELKETLWEKPGAIALSVGGGGLLCGVVQGLQEVGWGDVPVIAMETFGAHSFHAATTAGKLVSLPKITSVAKALGVKTVGAQALKLFQEHPIFSEVISDQEAVAAIEKFVDDEKILVEPACGAALAAVYSHVIQKLQLEGNLRTPLPSLVVIVCGGSNISLAQLRALKEQLGMTNRLPK

SEQ ID NO: 906 - protein, 1106 aa, Human
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQPPEDISCIAWNRQVQHILASASPSGRATVWDLRKNEPIIKVSDHSNRMHCSGLAWHPDVATQMVLASEDDRLPVIQMWDLRFASSPLRVLENHARGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKIALALNKVDGANVALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQRPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 907 - protein, 405 aa, Human
MPLLLYTCLLWLPTSGLWTVQAMDPNAAYVNMSNHHRGLASANVDFAFSLYKHLVALSPKKNIFISPVSISMALAMLSLGTCGHTRAQLLQGLGFNLTERSETEIHQGFQHLHQLFAKSDTSLEMTMGNALFLDGSLELLESFSADIKHYYESEVLAMNFQDWATASRQINSYVKNKTQGKIVDLFSGLDSPAILVLVNYIFFKGTWTQPFDLASTREENFYVDETTVVKVPMMLQSSTISYLHDAELPCQLVQMNYVGNGTVFFILPDKGKMNTVIAALSRDTINRWSAGLTSSQVDLYIPKVTISGVYDLGDVLEEMGIADLFTNQANFSRITQDAQLKSSKVVHKAVLQLNEEGVDTAGSTGVTLNLTSKPIILRFNQPFIIMIFDHFTWSSLFLARVMNPV

SEQ ID NO: 908 - protein, 628 aa, Human
MEVSAAKAPSAADLSEIEIKKEMKKDPLTNKAPEKPLHEVPSGNSLLSSETILRTNKRGERRRRRCQVAFSYLPQNDDELELKVGDIIEVVGEVEEGWWEGVLNGKTGMFPSNFIKELSGESDELGISQDEQLSKSSLRETTGSESDGGDSSSTKSEGANGTVATAAIQPKKVKGVGFGDIFKDKPIKLRPRSIEVENDFLPVEKTIGKKLPATTATPDSSKTEMDSRTKSKDYCKVIFPYEAQNDDELTIKEGDIVTLINKDCIDVGWWEGELNGRRGVFPDNFVKLLPPDFEKEGNRPKKPPPPSAPVIKQGAGTTERKHEIKKIPPERPEMLPNRTEEKERPEREPKLDLQKPSVPAIPPKKPRPPKTNSLSRPGALPPRRPERPVGPLTHTRGDSPKIDLAGSSLSGILDKDLSDRSNDIDLEGFDSVVSSTEKLSHPTTSRPKATGRRPPSQSLTSSSLSSPDIFDSPSPEEDKEEHISLAHRGVDASKKTSKTVTISQVSDNKASLPPKPGTMAAGGGGPAPLSSAAPSPLSSSLGTAGHRANSPSLFGTEGKPKMEPAASSQAAVEELRTQVRELRSIIETMKDQQKREIKQLLSELDEEKKIRLRLQMEVNDIKKALQSK

SEQ ID NO: 909 - protein, 465 aa, Human
MNVTSLFSFTSPAVKRLLGWKQGDEEEKWAEKAVDALVKKLKKKKGAMEELEKALSCPGQPSNCVTIPRSLDGRLQVSHRKGLPHVIYCRVWRWPDLQSHHELKPLECCEFPFGSKQKEVCINPYHYKRVESPVLPPVLVPRHSEYNPQHSLLAQFRNLGQNEPHMPLNATFPDSFQQPNSHPFPHSPNSSYPNSPGSSSSTYPHSPTSSDPGSPFQMPADTPPPAYLPPEDPMTQDGSQPMDTNMMAPPLPSEINRGDVQAVAYEEPKHWCSIVYYELNNRVGEAFHASSTSVLVDGFTDPSNNKNRFCLGLLSNVNRNSTIENTRRHIGKGVHLYYVGGEVYAECLSDSSIFVQSRNCNYHHGFHPTTVCKIPSGCSLKIFNNQEFAQLLAQSVNHGFETVYELTKMCTIRMSFVKGWGAEYHRQDVTSTPCWIEIHLHGPLQWLDKVLTQMGSPHNPISSVS

SEQ ID NO: 910 - protein, 193 aa, Human
MLEVHIPSVGPEAEGPRQSPEKSHMVFRVEVLCSGRRHTVPRRYSEFHALHKRIKKLYKVPDFPSKRLPNWRTRGLEQRRQGLEAYIQGILYLNQEVPKELLEFLRLRHFPTDPKASNWGTLREFLPGDSSSQQHQRPVLSFHVDPYVCNPSPESLPNVVVNGVLQGLYSFSISPDKAQPKAACHPAPLPPMP

SEQ ID NO: 911 - protein, 622 aa, Human
MSMRSPISAQLALDGVGTMVNCTIKSEEKKEPCHEAPQGSATAAEPQPGDPARASQDSADPQAPAQGNFRGSWDCSSPEGNGSPEPKRPGVSEAASGSQEKLDFNRNLKEVVPAIEKLLSSDWKERFLGRNSMEAKDVKGTQESLAEKELQLLVMIHQLSTLRDQLLTAHSEQKNMAAMLFEKQQQQMELARQQQEQIAKQQQQLIQQQHKINLLQQQIQQVNMPYVMIPAFPPSHQPLPVTPDSQLALPIQPIPCKPVEYPLQLLHSPPAPVVKRPGAMATHHPLQEPSQPLNLTAKPKAPELPNTSSSPSLKMSSCVPRPPSHGGPTRDLQSSPPSLPLGFLGEGDAVTKAIQDARQLLHSHSGALDGSPNTPFRKDLISLDSSPAKERLEDGCVHPLEEAMLSCDMDGSRHFPESRNSSHIKRPMNAFMVWAKDERRKILQAFPDMHNSSISKILGSRWKSMTNQEKQPYYEEQARLSRQHLEKYPDYKYKPRPKRTCIVEGKRLRVGEYKALMRTRRQDARQSYVIPPQAGQVQMSSSDVLYPRAAGMPLAQPLVEHYVPRSLDPNMPVIVNTCSLREEGEGTDDRHSVADGEMYRYSEDEDSEGEEKSDGELVVLTD

SEQ ID NO: 912 - protein, 627 aa, Human
MAAEKQVPGGGGGGGSGGGGGSGGGGSGGGRGAGGEENKENERPSAGSKANKEFGDSLSLEILQIIKESQQQHGLRHGDFQRYRGYCSRRQRRLRKTLNFKMGNRHKFTGKKVTEELLTDNRYLLLVLMDAERAWSYAMQLKQEANTEPRKRFHLLSRLRKAVKHAEELERLCESNRVDAKTKLEAQAYTAYLSGMLRFEHQEWKAAIEAFNKCKTIYEKLASAFTEEQAVLYNQRVEEISPNIRYCAYNIGDQSAINELMQMRLRSGGTEGLLAEKLEALITQTRAKQAATMSEVEWRGRTVPVKIDKVRIFLLGLADNEAAIVQAESEETKERLFESMLSECRDAIQVVREELKPDQKQRDYILEGEPGKVSNLQYLHSYLTYIKLSTAIKRNENMAKGLQRALLQQQPEDDSKRSPRPQDLIRLYDIILQNLVELLQLPGLEEDKAFQKEIGLKTLVFKAYRCFFIAQSYVLVKKWSEALVLYDRVLKYANEVNSDAGAFKNSLKDLPDVQELITQVRSEKCSLQAAAILDANDAHQTETSSSQVKDNKPLVERFETFCLDPSLVTKQANLVHFPPGFQPIPCKPLFFDLALNHVAFPPLEDKLEQKTKSGLTGYIKGIFGFRS

SEQ ID NO: 913 - protein, 227 aa, Human
MEKLFNENEGMPSNQGKIDNEEQPPHEGKPEVACILEDKKLENEGNTENTGKRVEEPLKDKEKPESAGKAKGEGKSERKGKSEMQGGSKTEGKPERGGRAEGEGEPDSEREPESEGEPESETRAAGKRPAEDDIPRKAKRKTNKGLAQYLKQYKEAIHDMNFSNEDMIREFDNMARVEDKRRKSKQKLGAFLWMQRNLQDPFYPRGPREFRGGCRAPRRDTEDIPYV

SEQ ID NO: 914 - protein, 798 aa, Human
MHGGRSCGPRTRREPSSGEEAAPVTAMAAESALQVVEKLQARLAANPDPKKLLKYLKKLSTLPITVDILAETGVGKTVNSLRKHEHVGSFARDLVAQWKKLVPVERNAEPDEQDFEKSNSRKRPRDALQKEEEMEGDYQETWKATGSRSYSPDHRQKKHRKLSELERPHKVSHGHERRDERKRCHRMSPTYSSDPESSDYGHVQSPPSCTSPHQMYVDHYRSLEEDQEPIVSHQKPGKGHSNAFQDRLGASQERHLGEPHGKGVVSQNKEHKSSHKDKRPVDAKSDEKASVVSREKSHKALSKEENRRPPSGDNAREKPPSSGVKKEKDREGSSLKKKCLPPSEAASDNHLKKPKHRDPEKAKLDKSKQGLDSFDTGKGAGDLLPKVKEKGSNNLKTPEGKVKTNLDRKSLGSLPKVEETDMEDEFEQPTMSFESYLSYDQPRKKKKKIVKTSATALGDKGLKKNDSKSTGKNLDSVQKLPKVNKTKSEKPAGADLAKLRKVPDVLPVLPDLPLPAIQANYRPLPSLELISSFQPKRKAFSSPQEEEEAGFTGRRMNSKMQVYSGSKCAYLPKMMTLHQQCIRVLKNNIDSIFEVGGVPYSVLEPVLERCTPDQLYRIEEYNHVLIEETDQLWKVHCHRDFKEERPEEYESWREMYLRLQDAREQRLRVLTKNIQFAHANKPKGRQAKMAFVNSVAKPPRDVRRRQEKFGTGGAAVPEKIKIKPAPYPMGSSHASASSISFNPSPEEPAYDGPSTSSAHLAPVVSSTVSYDPRKPTVKKIAPMMAKTIKAFKNRFSRR

SEQ ID NO: 915 - protein, 1077 aa, Human
MAERGGDGGESERFNPGELRMAQQQALRFRGPAPPPNAVMRGPPPLMRPPPPFGMMRGPPPPPRPPFGRPPFDPNMPPMPPPGGIPPPMGPPHLQRPPFMPPPMSSMPPPPGMMFPPGMPPVTAPGTPALPPTEEIWVENKTPDGKVYYYNARTRESAWTKPDGVKVIQQSELTPMLAAQAQVQAQAQAQAQAQAQAQAQAQAQAQAQAQAQAQAQAQAQAQAQAQAQAQAQAQAQAQAQAQVQAQVQAQVQAQAVGASTPTTSSPAPAVSTSTSSSTPSSTTSTTTTATSVAQTVSTPTTQDQTPSSAVSVATPTVSVSTPAPTATPVQTVPQPHPQTLPPAVPHSVPQPTTAIPAFPPVMVPPFRVPLPGMPIPLPGVLPGMAPPIVPMIHPQVAIAASPATLAGATAVSEWTEYKTADGKTYYYNNRTLESTWEKPQELKEKEKLEEKIKEPIKEPSEEPLPMETEEEDPKEEPIKEIKEEPKEEEMTEEEKAAQKAKPVATAPIPGTPWCVVWTGDERVFFYNPTTRLSMWDRPDDLIGRADVDKIIQEPPHKKGMEELKKLRHPTPTMLSIQKWQFSMSAIKEEQELMEEINEDEPVKAKKRKRDDNKDIDSEKEAAMEAEIKAARERAIVPLEARMKQFKDMLLERGVSAFSTWEKELHKIVFDPRYLLLNPKERKQVFDQYVKTRAEEERREKKNKIMQAKEDFKKMMEEAKFNPRATFSEFAAKHAKDSRFKAIEKMKDREALFNEFVAAARKKEKEDSKTRGEKIKSDFFELLSNHHLDSQSRWSKVKDKVESDPRYKAVDSSSMREDLFKQYIEKIAKNLDSEKEKELERQARIEASLREREREVQKARSEQTKEIDREREQHKREEAIQNFKALLSDMVRSSDVSWSDTRRTLRKDHRWESGSLLEREEKEKLFNEHIEALTKKKREHFRQLLDETSAITLTSTWKEVKKIIKEDPRCIKFSSSDRKKQREFEEYIRDKYITAKADFRTLLKETKFITYRSKKLIQESDQHLKDVEKILQNDKRYLVLDCVPEERRKLIVAYVDDLDRRGPPPPPTASEPTRRSTK

SEQ ID NO: 916 - protein, 1411 aa, Human
MAEARKRRELLPLIYHHLLRAGYVRAAREVKEQSGQKCFLAQPVTLLDIYTHWQQTSELGRKRKAEEDAALQAKKTRVSDPISTSESSEEEEEAEAETAKATPRLASTNSSVLGADLPSSMKEKAKAETEKAGKTGNSMPHPATGKTVANLLSGKSPRKSAEPSANTTLVSETEEEGSVPAFGAAAKPGMVSAGQADSSSEDTSSSSDETDVEVKASEKILQVRAASAPAKGTPGKGATPAPPGKAGAVASQTKAGKPEEDSESSSEESSDSEEETPAAKALLQAKASGKTSQVGAASAPAKESPRKGAAPAPPGKTGPAVAKAQAGKREEDSQSSSEESDSEEEAPAQAKPSGKAPQVRAASAPAKESPRKGAAPAPPRKTGPAAAQVQVGKQEEDSRSSSEESDSDREALAAMNAAQVKPLGKSPQVKPASTMGMGPLGKGAGPVPPGKVGPATPSAQVGKWEEDSESSSEESSDSSDGEVPTAVAPAQEKSLGNILQAKPTSSPAKGPPQKAGPVAVQVKAEKPMDNSESSEESSDSADSEEAPAAMTAAQAKPALKIPQTKACPKKTNTTASAKVAPVRVGTQAPRKAGTATSPAGSSPAVAGGTQRPAEDSSSSEESDSEEEKTGLAVTVGQAKSVGKGLQVKAASVPVKGSLGQGTAPVLPGKTGPTVTQVKAEKQEDSESSEEESDSEEAAASPAQVKTSVKKTQAKANPAAARAPSAKGTISAPGKVVTAAAQAKQRSPSKVKPPVRNPQNSTVLARGPASVPSVGKAVATAAQAQTGPEEDSGSSEEESDSEEEAETLAQVKPSGKTHQIRAALAPAKESPRKGAAPTPPGKTGPSAAQAGKQDDSGSSSEESDSDGEAPAAVTSAQVIKPPLIFVDPNRSPAGPAATPAQAQAASTPRKARASESTARSSSSESEDEDVIPATQCLTPGIRTNVVTMPTAHPRIAPKASMAGASSSKESSRISDGKKQEGPATQVSKKNPASLPLTQAALKVLAQKASEAQPPVARTQPSSGVDSAVGTLPATSPQSTSVQAKGTNKLRKPKLPEVQQATKAPESSDDSEDSSDSSSGSEEDGEGPQGAKSAHTLGPTPSRTETLVEETAAESSEDDVVAPSQSLLSGYMTPGLTPANSQASKATPKLDSSPSVSSTLAAKDDPDGKQEAKPQQAAGMLSPKTGGKEAASGTTPQKSRKPKKGAGNPQASTLALQSNITQCLLGQPWPLNEAQVQASVVKVLTELLEQERKKVVDTTKESSRKGWESRKRKLSGDQPAARTPRSKKKKKLGAGEGGEASVSPEKTSTTSKGKAKRDKASGDVKEKKGKGSLGSQGAKDEPEEELQKGMGTVEGGDQSNPKSKKEKKKSDKRKKDKEKKEKKKKAKKASTKDSESPSQKKKKKKKKTAEQTV

SEQ ID NO: 917 - protein, 95 aa, Human
MEGGFGSDFGGSGSGKLDPGLIMEQVKVQIAVANAQELLQRMTDKCFRKCIGKPGGSLDNSEQKCIAMCMDRYMDAWNTVSRAYNSRLQRERANM

SEQ ID NO: 918 - protein, 953 aa, Human
MALVFQFGQPVRAQPLPGLCHGKLIRTNACDVCNSTDLPEVEIISLLEEQLPHYKLRADTIYGYDHDDWLHTPLISPDANIDLTTEQIEETLKYFLLCAERVGQMTKTYNDIDAVTRLLEEKERDLELAARIGQSLLKKNKTLTERNELLEEQVEHIREEVSQLRHELSMKDELLQFYTSAAEESEPESVCSTPLKRNESSSSVQNYFHLDSLQKKLKDLEEENVVLRSEASQLKTETITYEEKEQQLVNDCVKELRDANVQIASISEELAKKTEDAARQQEEITHLLSQIVDLQKKAKACAVENEELVQHLGAAKDAQRQLTAELRELEDKYAECMEMLHEAQEELKNLRNKTMPNTTSRRYHSLGLFPMDSLAAEIEGTMRKELQLEEAESPDITHQKRVFETVRNINQVVKQRSLTPSPMNIPGSNQSSAMNSLLSSCVSTPRSSFYGSDIGNVVLDNKTNSIILETEAADLGNDERSKKPGTPGTPGSHDLETALRRLSLRRENYLSERRFFEEEQERKLQELAEKGELRSGSLTPTESIMSLGTHSRFSEFTGFSGMSFSSRSYLPEKLQIVKPLEGSATLHHWQQLAQPHLGGILDPRPGVVTKGFRTLDVDLDEVYCLNDFEEDDTGDHISLPRLATSTPVQHPETSAHHPGKCMSQTNSTFTFTTCRILHPSDELTRVTPSLNSAPTPACGSTSHLKSTPVATPCTPRRLSLAESFTNTRESTTTMSTSLGLVWLLKERGISAAVYDPQSWDRAGRGSLLHSYTPKMAVIPSTPPNSPMQTPTSSPPSFEFKCTSPPYDNFLASKPASSILREVREKNVRSSESQTDVSVSNLNLVDKVRRFGVAKVVNSGRAHVPTLTEEQGPLLCGPPGPAPALVPRGLVPEGLPLRCPTVTSAIGGLQLNSGIRRNRSFPTMVGSSMQMKAPVTLTSGILMGAKLSKQTSLR

SEQ ID NO: 919 - protein, 481 aa, Human
MASAASVTSLADEVNCPICQGTLREPVTIDCGHNFCRACLTRYCEIPGPDLEESPTCPLCKEPFRPGSFRPNWQLANVVENIERLQLVSTLGLGEEDVCQEHGEKIYFFCEDDEMQLCVVCREAGEHATHTMRFLEDAAAPYREQIHKCLKCLRKEREEIQEIQSRENKRMQVLLTQVSTKRQQVISEFAHLRKFLEEQQSILLAQLESQDGDILRQRDEFDLLVAGEICRFSALIEELEEKNERPARELLTDIRSTLIRCETRKCRKPVAVSPELGQRIRDFPQQALPLQREMKMFLEKLCFELDYEPAHISLDPQTSHPKLLLSEDHQRAQFSYKWQNSPDNPQRFDRATCVLAHTGITGGRHTWVVSIDLAHGGSCTVGVVSEDVQRKGELRLRPEEGVWAVRLAWGFVSALGSFPTRLTLKEQPRQVRVSLDYEVGWVTFTNAVTREPIYTFTASFTRKVIPFFGLWGRGSSFSLSS

SEQ ID NO: 920 - protein, 755 aa, Human
MVSHGSSPSLLEALSSDFLACKICLEQLRAPKTLPCLHTYCQDCLAQLADGGRVRCPECRETVPVPPEGVASFKTNFFVNGLLDLVKARACGDLRAGKPACALCPLVGGTSTGGPATARCLDCADDLCQACADGHRCTRQTHTHRVVDLVGYRAGWYDEEARERQAAQCPQHPGEALRFLCQPCSQLLCRECRLDPHLDHPCLPLAEAVRARRPGLEGLLAGVDNNLVELEAARRVEKEALARLREQAARVGTQVEEAAEGVLRALLAQKQEVLGQLRAHVEAAEEAARERLAELEGREQVARAAAAFARRVLSLGREAEILSLEGAIAQRLRQLQGCPWAPGPAPCLLPQLELHPGLLDKNCHLLRLSFEEQQPQKDGGKDGAGTQGGEESQSRREDEPKTERQGGVQPQAGDGAQTPKEEKAQTTREEGAQTLEEDRAQTPHEDGGPQPHRGGRPNKKKKFKGRLKSISREPSPALGPNLDGSGLLPRPIFYCSFPTRMPGDKRSPRITGLCPFGPREILVADEQNRALKRFSLNGDYKGTVPVPEGCSPCSVAALQSAVAFSASARLYLINPNGEVQWRRALSLSQASHAVAALPSGDRVAVSVAGHVEVYNMEGSLATRFIPGGKASRGLRALVFLTTSPQGHFVGSDWQQNSVVICDGLGQVVGEYKGPGLHGCQPGSVSVDKKGYIFLTLREVNKVVILDPKGSLLGDFLTAYHGLEKPRVTTMVDGRYLVVSLSNGTIHIFRVRSPDS

SEQ ID NO: 921 - protein, 234 aa, Human
MGGCVGAQHDSSGSLNENSEGTGVALGRNQPLKKEKPKWKSDYPMTDGQLRSKRDEFWDTAPAFEGRKEIWDALKAAAHAFESNDHELAQAIIDGANITLPHGALTECYDELGNRYQLPVYCLAPPINMIEEKSDIETLDIPEPPPNSGYECQLRLRLSTGKDLKLVVRSTDTVFHMKRRLHAAEGVEPGSQRWFFSGRPLTDKMKFEELKIPKDYVVQVIVSQPVQNPTPVEN

SEQ ID NO: 922 - protein, 530 aa, Human
MARTGWTSPIPLCVSLLLTCGFAEAGKLLVVPMDGSHWFTMQSVVEKLILRGHEVVVVMPEVSWQLGKSLNCTVKTYSTSYTLEDLDREFMDFADAQWKAQVRSLFSLFLSSSNGFFNLFFSHCRSLFNDRKLVEYLKESSFDAVFLDPFDACGLIVAKYFSLPSVVFARGIACHYLEEGAQCPAPLSYVPRILLGFSDAMTFKERVRNHIMHLEEHLFCQYFSKNALEIASEILQTPVTAYDLYSHTSIWLLRTDFVLDYPKPVMPNMIFIGGINCHQGKPLPMEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 923 - protein, 522 aa, Human
MAGIIKKQILKHLSRFTKNLSPDKINLSTLKGEGELKNLELDEEVLQNMLDLPTWLAINKVFCNKASIRIPWTKLKTHPICLSLDKVIMEMSTCEEPRSPNGPSPIATASGQSEYGFAEKVVEGISVSVNSIVIRIGAKAFNASFELSQLRIYSVNAHWEHGDLRFTRIQDPQRGEVLTFKEINWQMIRIEADATQSSHLEIMCAPVRLITNQSKIRVTLKRRLKDCNVIATKLVLILDDLLWVLTDSQLKAMVQYAKSLSEAIEKSTEQRKSMAPEPTQSSTVVASAQQVKTTQTSNAPDVNDAIVKLFNDFDVKETSHHLVISHLDLHICDDIHAKEKESNRRITGGAMQLSFTQLTIDYYPYHKAGDSCNHWMYFSDATKTKNGWANELLHEFECNVEMLKQAVKDHNVGSPPKSPTHASPQHTQTEKDYPLKGTCRTPSVLSQQSKAKLMSSSVVVRLADFNIYQVSTAEQCRSSPKSMICCNKKSLYLPQEMSAVYIEFTEYYYPDGKDFPTAFLSR

SEQ ID NO: 924 - protein, 1287 aa, Human
MVPGEENQLVPKEAPLDHTSDKSLLDANFEPGKKNFLHLTDKDGEQPQILLEDSSAGEDSVHDRFIGPLPREGSGGSTSDYVSQSYSYSSILNKSETGYVGLVNQAMTCYLNSLLQTLFMTPEFRNALYKWEFEESEEDPVTSIPYQLQRLFVLLQTSKKRAIETTDVTRSFGWDSSEAWQQHDVQELCRVMFDALEQKWKQTEQADLINELYQGKLKDYVRCLECGYEGWRIDTYLDIPLVIRPYGSSQAFASVEEALHAFIQPEILDGPNQYFCERCKKKCDARKGLRFLHFPYLLTLQLKRFDFDYTTMHRIKLNDRMTFPEELDMSTFIDVEDEKSPQTESCTDSGAENEGSCHSDQMSNDFSNDDGVDEGICLETNSGTEKISKSGLEKNSLIYELFSVMVHSGSAAGGHYYACIKSFSDEQWYSFNDQHVSRITQEDIKKTHGGSSGSRGYYSSAFASSTNAYMLIYRLKDPARNAKFLEVDEYPEHIKNLVQKERELEEQEKRQREIERNTCKIKLFCLHPTKQVMMENKLEVHKDKTLKEAVEMAYKMMDLEEVIPLDCCRLVKYDEFHDYLERSYEGEEDTPMGLLLGGVKSTYMFDLLLETRKPDQVFQSYKPGEVMVKVHVVDLKAESVAAPITVRAYLNQTVTEFKQLISKAIHLPAETMRIVLERCYNDLRLLSVSSKTLKAEGFFRSNKVFVESSETLDYQMAFADSHLWKLLDRHANTIRLFVLLPEQSPVSYSKRTAYQKAGGDSGNVDDDCERVKGPVGSLKSVEAILEESTEKLKSLSLQQQQDGDNGDSSKSTETSDFENIESPLNERDSSASVDNRELEQHIQTSDPENFQSEERSDSDVNNDRSTSSVDSDILSSSHSSDTLCNADNAQIPLANGLDSHSITSSRRTKANEGKKETWDTAEEDSGTDSEYDESGKSRGEMQYMYFKAEPYAADEGSGEGHKWLMVHVDKRITLAAFKQHLEPFVGVLSSHFKVFRVYASNQEFESVRLNETLSSFSDDNKITIRLGRALKKGEYRVKVYQLLVNEQEPCKFLLDAVFAKGMTVRQSKEELIPQLREQCGLELSIDRFRLRKKTWKNPGTVFLDYHIYEEDINISSNWEVFLEVLDGVEKMKSMSQLAVLSRRWKPSEMKLDPFQEVVLESSSVDELREKLSEISGIPLDDIEFAKGRGTFPCDISVLDIHQDLDWNPKVSTLNVWPLYICDDGAVIFYRDKTEELMELTDEQRNELMKKESSRLQKTGHRVTYSPRKEKALKIYLDGAPNKDLTQD

SEQ ID NO: 925 - protein, 393 aa, Human
MSDEREVAEAATGEDASSPPPKTEAASDPQHPAASEGAAAAAASPPLLRCLVLTGFGGYDKVKLQSRPAAPPAPGPGQLTLRLRACGLNFADLMARQGLYDRLPPLPVTPGMEGAGVVIAVGEGVSDRKAGDRVMVLNRSGMWQEEVTVPSVQTFLIPEAMTFEEAAALLVNYITAYMVLFDFGNLQPGHSVLVHMAAGGVGMAAVQLCRTVENVTVFGTASASKHEALKENGVTHPIDYHTTDYVDEIKKISPKGVDIVMDPLGGSDTAKGYNLLKPMGKVVTYGMANLLTGPKRNLMALARTWWNQFSVTALQLLQANRAVCGFHLGYLDGEVELVSGVVARLLALYNQGHIKPHIDSVWPFEKVADAMKQMQEKKNVGKVLLVPGPEKEN

SEQ ID NO: 926 - protein, 927 aa, Human
MTAEETVNVKEVEIIKLILDFLNSKKLHISMLALEKESGVINGLFSDDMLFLRQLILDGQWDEVLQFIQPLECMEKFDKKRFRYIILKQKFLEALCVNNAMSAEDEPQHVRFLFLKLEFTMQEAVQCLHALEEYCPSKDDYSKLCLLLTLPRLTNHAEFKDWNPSTARVHCFEEACVMVAEFIPADRKLSEAGFKASNNRLFQLVMKGLLYECCVEFCQSKATGEEITESEVLLGIDLLCGNGCDDLDLSLLSWLQNLPSSVFSCAFEQKMLNIHVDKLLKPTKAAYADLLTPLISKLSPYPSSPMRRPQSADAYMTRSLNPALDGLTCGLTSHDKRISDLGNKTSPMSHSFANFHYPGVQNLSRSLMLENTECHSIYEESPERSDTPVDAQRPIGSEILGQSSVSEKEPANGAQNPGPAKQEKNELRDSTEQFQEYYRQRLRYQQHLEQKEQQRQIYQQMLLEGGVNQEDGPDQQQNLTEQFLNRSIQKLGELNIGMDGLGNEVSALNQQCNGSKGNGSNGSSVTSFTTPPQDSSQRLTHDASNIHTSTPRNPGSTNHIPFLEESPCGSQISSEHSVIKPPLGDSPGSLSRSKGEEDDKSKKQFVCINILEDTQAVRAVAFHPAGGLYAVGSNSKTLRVCAYPDVIDPSAHETPKQPVVRFKRNKHHKGSIYCVAWSPCGQLLATGSNDKYVKVLPFNAETCNATGPDLEFSMHDGTIRDLAFMEGPESGGAILISAGAGDCNIYTTDCQRGQGLHALSGHTGHILALYTWSGWMIASGSQDKTVRFWDLRVPSCVRVVGTTFHGTGSAVASVAVDPSGRLLATGQEDSSCMLYDIRGGRMVQSYHPHSSDVRSVRFSPGAHYLLTGSYDMKIKVTDLQGDLTKQLPIMVVGEHKDKVIQCRWHTQDLSFLSSSADRTVTLWTYNG

SEQ ID NO: 927 - protein, 1160 aa, Human
MHPQSLAEEEIKTEQEVVEGMDISTRSKDPGSAERTAQKRKFPSPPHSSNGHSPQDTSTSPIKKKKKPGLLNSNNKEQSELRHGPFYYMKQPLTTDPVDVVPQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSTVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSDHSRSNKSSWSSSDEKRGSTRSDHNTSTSTKSLLPKESRLDTFWD

SEQ ID NO: 928 - protein, 576 aa, Human
MDDLKYGVYPLKEASGCPGAERNLLVYSYFEKETLTFRDVAIEFSLEEWECLNPAQQNLYMNVMLENYKNLVFLGVAVSKQDPVTCLEQEKEPWNMKRHEMVDEPPAMCSYFTKDLWPEQDIKDSFQQVILRRYGKCEHENLQLRKGSASVDEYKVHKEGYNELNQCLTTTQSKIFPCDKYVKVFHKFLNANRHKTRHTGKKPFKCKKCGKSFCMLLHLSQHKRIHIRENSYQCEECGKAFKWFSTLTRHKRIHTGEKPFKCEECGKAFKQSSTLTTHKIIHTGEKPYRCEECGKAFNRSSHLTTHKIIHTGEKPYKCEECGKAFNQSSTLSTHKFIHAGEKPYKCEECDKAFNRFSYLTKHKIIHTGEKSYKCEECGKGFNWSSTLTKHKRIHTGEKPYKCEVCGKAFNESSNLTTHKMIHTGEKPYKCEECGKAFNRSPQLTAHKIIHTGEKPYKCEECGKAFSQSSILTTHKRIHTGEKPYKCEECGKAFNRSSNLTKHKIIHTGEKSYKCEECGKAFNQSSTLTKHRKIHTRQKPYNCEECDNTFNQSSNLIKQNNSYWRETLQMSRMWESL

SEQ ID NO: 929 - protein, 476 aa, Human
MDAVAFEDVAVNFTQEEWALLGPSQKNLYRYVMQETIRNLDCIRMIWEEQNTEDQYKNPRRNLRCHMVERFSESKDSSQCGETFSLIRDSIVNNSICPGEDPCQSAECEEVIMGHLSLNSHIRVDSGHKPHEYQEYGEKPHTHKQRGKAFSYHHSFQSRGRPHTGKKRYECKECGKTFSSRRNLRRHMVVQGGNRPYKCKLCGKAFFWPSLLRMHERTHTGEKPYECKQCSKAFPFYSSYRRHERMHTGEKPYECKQCSKALPDSSSYIRHERTHTGEKPYTCKQCGKAFSVSSSLRRHETTHSAEKPYECKQCGKTFHHLGSFQIHMKRHTGDRPHKCKICGKGFDRPSLVRYHERIHTGEKPYECKQCGKTLSHSSSFRRHMIMHTGGGPHKCKICGKAFVYPSVCQRHEKSHSGEKPYECKQCGKALSHSSSFRRHMVMHTGDGPNKCKVCGKAFVYPSVCQRHEKTHWRETI

SEQ ID NO: 930 - protein, 543 aa, Human
MSSFSYEPYYSTSYKRRYVETPRVHISSVRSGYSTARSAYSSYSAPVSSSLSVRRSYSSSSGSLMPSLENLDLSQVAAISNDLKSIRTQEKAQLQDLNDRFASFIERVHELEQQNKVLEAELLVLRQKHSEPSRFRALYEQEIRDLRLAAEDATNEKQALQGEREGLEETLRNLQARYEEEVLSREDAEGRLMEARKGADEAALARAELEKRIDSLMDEISFLKKVHEEEIAELQAQIQYAQISVEMDVTKPDLSAALKDIRAQYEKLAAKNMQNAEEWFKSRFTVLTESAAKNTDAVRAAKDEVSESRRLLKAKTLEIEACRGMNEALEKQLQELEDKQNADISAMQDTINKLENELRTTKSEMARYLKEYQDLLNVKMALDIEIAAYRKLLEGEETRLSFTSVGSITSGYSQSSQVFGRSAYGGLQTSSYLMSTRSFPSYYTSHVQEEQIEVEETIEAAKAEEAKDEPPSEGEAEEEEKDKEEAEEEEAAEEEEAAKEESEEAKEEEEGGEGEEGEETKEAEEEEKKVEGAGEEQAAKKKD

SEQ ID NO: 931 - protein, 174 aa, Human
MASSDIQVKELEKRASGQAFELILSPRSKESVPEFPLSPPKKKDLSLEEIQKKLEAAEERRKSHEAEVLKQLAEKREHEKEVLQKAIEENNNFSKMAEEKLTHKMEANKENREAQMAAKLERLREKMYFWTHGPGAHPAQISAEQSCLHSVPALCPALGLQSALITWSDLSHHH

SEQ ID NO: 932 - protein, 454 aa, Human
MLAENLVEEFEMKEDEPWYDHQDLQQDLQLAAELGKTLLDRNTELEDSVQQMYTTNQEQLQEIEYLTKQVELLRQMNEQHAKVYEQLDVTARELEETNQKLVADSKASQQKILSLTETIECLQTNIDHLQSQVEELKSSGQGRRSPGKCDQEKPAPSFACLKELYDLRQHFVYDHVFAEKITSLQGQPSPDEEENEHLKKTVTMLQAQLSLERQKRVTMEEEYGLVLKENSELEQQLGATGAYRARALELEAEVAEMRQMLQSEHPFVNGVEKLVPDSLYVPFKEPSQSLLEEMFLTVPESHRKPLKRSSSETILSSLAGSDIVKGHEETCIRRAKAVKQRGISLLHEVDTQYSALKVKYEELLKKCQEEQDSLSHKAVQTSRAAAKDLTGVNAQSEPVASGWELASVNPEPVSSPTTPPEYKALFKEIFSCIKKTKQEIDEQRTKYRSLSSHS

SEQ ID NO: 933 - protein, 205 aa, Human
MAASTASHRPIKGILKNKTSTTSSMVASAEQPRGNVDEELSKKSQKWDEMNILATYHPADKDYGLMKIDEPSTPYHSMMGDDEDACSDTEATEAMAPDILARKLAAAEGLEPKYRIQEQESSGEEDSDLSPEEREKKRQFEMKRKLHYNEGLNIKLARQLISKDLHDDDEDEEMLETADGESMNTEESNQGSTPSDQQQNKLRSS

SEQ ID NO: 934 - protein, 618 aa, Human
MAGLTLFVGRLPPSARSEQLEELFSQVGPVKQCFVVTEKGRTVAVDWAVAKDKYKDTQSVSAIGEEKSHESKHQESVKKKGREEEDMEEEENDDDDDDDDEEDGVFDDEDEEEENIESKVTKPVQIQKRAVKRPAPAKSSDHSEEDSDLEESDSIDDGEELAQSDTSTEEQEDKAVQVSNKKKRKLPSDVNEGKTVFIRNLSFDSEEEELGELLQQFGELKYVRIVLHPDTEHSKGCAFAQFMTQEAAQKCLLAASPENEAGGLKLDGRQLKVDLAVTRDEAAKLQTTKVKKPTGTRNLYLAREGLIRAGTKAAEGVSAADMAKRERFELLKHQKLKDQNIFVSRTRLCLHNLPKAVDDKQLRKLLLSATSGEKGVRIKECRVMRDLKGVHGNMKGQSLGYAFAEFQEHEHALKALRLINNNPEIFGPLKRPIVEFSLEDRRKLKMKELRIQRSLQKMRSKPATGEPQKGQPEPAKDQQQKAAQHHTEEQSKVPPEQKRKAGSTSWTGFQTKAEVEQVELPDGKKRRKVLALPSHRGPKIRLRDKGKVKPVHPKKPKPQINQWKQEKQQLSSEQVSRKKAKGNKTETRFNQLVEQYKQKLLGPSKGAPLAKRSKWFDS

SEQ ID NO: 935 - protein, 709 aa, Human
MAETLEFNDVYQEVKGSMNDGRLRLSRQGIIFKNSKTGKVDNIQAGELTEGIWRRVALGHGLKLLTKNGHVYKYDGFRESEFEKLSDFFKTHYRLELMEKDLCVKGWNWGTVKFGGQLLSFDIGDQPVFEIPLSNVSQCTTGKNEVTLEFHQNDDAEVSLMEVRFYVPPTQEDGVDPVEAFAQNVLSKADVIQATGDAICIFRELQCLTPRGRYDIRIYPTFLHLHGKTFDYKIPYTTVLRLFLLPHKDQRQMFFVISLDPPIKQGQTRYHFLILLFSKDEDISLTLNMNEEEVEKRFEGRLTKNMSGSLYEMVSRVMKALVNRKITVPGNFQGHSGAQCITCSYKASSGLLYPLERGFIYVHKPPVHIRFDEISFVNFARGTTTTRSFDFEIETKQGTQYTFSSIEREEYGKLFDFVNAKKLNIKNRGLKEGMNPSYDEYADSDEDQHDAYLERMKEEGKIREENANDSSDDSGEETDESFNPGEEEEDVAEEFDSNASASSSSNEGDSDRDEKKRKQLKKAKMAKDRKSRKKPVEVKKGKDPNAPKRPMSAYMLWLNASREKIKSDHPGISITDLSKKAGEIWKGMSKEKKEEWDRKAEDARRDYEKAMKEYEGGRGESSKRDKSKKKKKVKVKMEKKSTPSRGSSSKSSSRQLSESFKSKEFVSSDESSSGENKSKKKRRRSEDSEEEELASTPPSSEDSASGSDE

SEQ ID NO: 936 - protein, 346 aa, Human [sequence omitted]

SEQ ID NO: 937 - protein, 484 aa, Human
MYDDSYVPGFEDSEAGSADSYTSRPSLDSDVSLEEDRESARREVESQAQQQLERAKHKPVAFAVRTNVSYCGVLDEECPVQGSGVNFEAKDFLHIKEKYSNDWWIGRLVKEGGDIAFIPSPQRLESIRLKQEQKARRSGNPSSLSDIGNRRSPPPSLAKQKQKQAEHVPPYDVVPSMRPVVLVGPSLKGYEVTDMMQKALFDFLKHRFDGRISITRVTADLSLAKRSVLNNPGKRTIIERSSARSSIAEVQSEIERIFELAKSLQLVVLDADTINHPAQLAKTSLAPIIVFVKVSSPKVLQRLIRSRGKSQMKHLTVQMMAYDKLVQCPPESFDVILDENQLEDACEHLAEYLEVYWRATHHPAPGPGLLGPPSAIPGLQNQQLLGERGEEHSPLERDSLMPSDEASESSRQAWTGSSQRSSRHLEEDYADAYQDLYQPHRQHTSGLPSANGHDPQDRLLAQDSEHNHSDRNWQRNRPWPKDSY

SEQ ID NO: 938 - protein, 416 aa, Human
MDEADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTS

SEQ ID NO: 939 - protein, 1710 aa, Human
MNGHSDEESVRNSSGESSQSDDDSGSASGSGSGSSSGSSSDGSSSQSGSSDSDSGSESGSQSESESDTSRENKVQAKPPKVDGAEFWKSSPSILAVQRSAILKKQQQQQQQQQHQASSNSGSEEDSSSSEDSDDSSSEVKRKKHKDEDWQMSGSGSPSQSGSDSESEEEREKSSCDETESDYEPKNKVKSRKPQNRSKSKNGKKILGQKKRQIDSSEEDDDEEDYDNDKRSSRRQATVNVSYKEDEEMKTDSDDLLEVCGEDVPQPEEEEFETIERFMDCRIGRKGATGATTTIYAVEADGDPNAGFEKNKEPGEIQYLIKWKGWSHIHNTWETEETLKQQNVRGMKKLDNYKKKDQETKRWLKNASPEDVEYYNCQQELTDDLHKQYQIVERIIAHSNQKSAAGYPDYYCKWQGLPYSECSWEDGALISKKFQACIDEYFSRNQSKTTPFKDCKVLKQRPRFVALKKQPSYIGGHEGLELRDYQLNGLNWLAHSWCKGNSCILADEMGLGKTIQTISFLNYLFHEHQLYGPFLLVVPLSTLTSWQREIQTWASQMNAVVYLGDINSRNMIRTHEWTHHQTKRLKFNILLTTYEILLKDKAFLGGLNWAFIGVDEAHRLKNDDSLLYKTLIDFKSNHRLLITGTPLQNSLKELWSLLHFIMPEKFSSWEDFEEEHGKGREYGYASLHKELEPFLLRRVKKDVEKSLPAKVEQILRMEMSALQKQYYKWILTRNYKALSKGSKGSTSGFLNIMMELKKCCNHCYLIKPPDNNEFYNKQEALQHLIRSSGKLILLDKLLIRLRERGNRVLIFSQMVRMLDILAEYLKYRQFPFQRLDGSIKGELRKQALDHFNAEGSEDFCFLLSTRAGGLGINLASADTVVIFDSDWNPQNDLQAQARAHRIGQKKQVNIYRLVTKGSVEEDILERAKKKMVLDHLVIQRMDTTGKTVLHTGSAPSSSTPFNKEELSAILKFGAEELFKEPEGEEQEPQEMDIDEILKRAETHENEPGPLTVGDELLSQFKVANFSNMDEDDIELEPERNSKNWEEIIPEDQRRRLEEEERQKELEEIYMLPRMRNCAKQISFNGSEGRRSRSRRYSGSDSDSISEGKRPKKRGRPRTIPRENIKGFSDAEIRRFIKSYKKFGGPLERLDAIARDAELVDKSETDLRRLGELVHNGCIKALKDSSSGTERTGGRLGKVKGPTFRISGVQVNAKLVISHEEELIPLHKSIPSDPEERKQYTIPCHTKAAHFDIDWGKEDDSNLLIGIYEYGYGSWEMIKMDPDLSLTHKILPDDPDKKPQAKQLQTRADYLIKLLSRDLAKKEALSGAGSSKRRKARAKKNKAMKSIKVKEEIKSDSSPLPSEKSDEDDDKLSESKSDGRERSKKSSVSDAPVHITASGEPVPISEESEELDQKTFSICKERMRPVKAALKQLDRPEKGLSEREQLEHTRQCLIKIGDHITECLKEYTNPEQIKQWRKNLWIFVSKFTEFDARKLHKLYKHAIKKRQESQQNSDQNSNLNPHVIRNPDVERLKENTNHDDSSRDSYSSDRHLTQYHDHHKDRHQGDSYKKSDSRKRPYSSFSNGKDHRDWDHYKQDSRYYSDREKHRKLDDHRSRDHRSNLEGSLKDRSHSDHRSHSDHRLHSDHRSSSEYTHHKSSRDYRYHSDWQMDHRASSSGPRSPLDQRSPYGSRSPFEHSVEHKSTPEHTWSSRKT

SEQ ID NO: 940 - protein, 496 aa, Human
MFAKATRNFLREVDADGDLIAVSNLNDSDKLQLLSLVTKKKRFWCWQRPKYQFLSLTLGDVLIEDQFPSPVVVESDFVKYEGKFANHVSGTLETALGKVKLNLGGSSRVESQSSFGTLRKQEVDLQQLIRDSAERTINLRNPVLQQVLEGRNEVLCVLTQKITTMQKCVISEHMQVEEKCGGIVGIQTKTVQVSATEDGNVTKDSNVVLEIPAATTIAYGVIELYVKLDGQFEFCLLRGKQGGFENKKRIDSVYLDPLVFREFAFIDMPDAAHGISSQDGPLSVLKQATLLLERNFHPFAELPEPQQTALSDIFQAVLFDDELLMVLEPVCDDLVSGLSPTVAVLGELKPRQQQDLVAFLQLVGCSLQGGCPGPEDAGSKQLFMTAYFLVSALAEMPDSAAALLGTCCKLQIIPTLCHLLRALSDDGVSDLEDPTLTPLKDTERFGIVQRLFASADISLERLKSSVKAVILKDSKVFPLLLCITLNGLCALGREHS

SEQ ID NO: 941 - protein, 380 aa, Human
MGIQGLAKLIADVAPSAIRENDIKSYFGRKVAIDASMSIYQFLIAVRQGGDVLQNEEGETTSHLMGMFYRTIRMMENGIKPVYVFDGKPPQLKSGELAKRSERRAEAEKQLQQAQAAGAEQEVEKFTKRLVKVTKQHNDECKHLLSLMGIPYLDAPSEAEASCAALVKAGKVYAAATEDMDCLTFGSPVLMRHLTASEAKKLPIQEFHLSRILQELGLNQEQFVDLCILLGSDYCESIRGIGPKRAVDLIQKHKSIEEIVRRLDPNKYPVPENWLHKEAHQLFLEPEVLDPESVELKWSEPNEEELIKFMCGEKQFSEERIRSGVKRLSKSRQGSTQGRLDDFFKVTGSLSSAKRKEPEPKGSTKKKAKTGAAGKFKRGK

SEQ ID NO: 942 - protein, 291 aa, Human
MDPSLLRERELFKKRALSTPVVEKRSASSESSSSSSKKKKTKVEHGGSSGSKQNSDHSNGSFNLKALSGSSGYKFGVLAKIVNYMKTRHQRGDTHPLTLDEILDETQHLDIGLKQKQWLMTEALVNNPKIEVIDGKYAFKPKYNVRDKKALLRLLDQHDQRGLGGILLEDIEEALPNSQKAVKALGDQILFVNRPDKKKILFFNDKSCQFSVDEEFQKLWRSVTVDSMDEEKIEEYLKRQGISSMQESGPKKVAPIQRRKKPASQKKRRFKTHNEHLAGVLKDYSDITSSK

SEQ ID NO: 943 - protein, 610 aa, Human
MQYLNTFYGCPKESCNLFVLKDTLKKMQKFFGLPQTGDLDQNTIETMRKPRCGNPDVANYNFFPRKPKWDKNQITYRIIGYTPDLDPETVDDAFARAFQVWSDVTPLRFSRIHDGEADIMINFGRWEHGDGYPFDGKDGLLAHAFAPGTGVGGDSHFDDDELWTLGEGQVVRVKYGNADGEYCKFPFLFNGKEYNSCTDTGRSDGFLWCSTTYNFEKDGKYGFCPHEALFTMGGNAEGQPCKFPFRFQGTSYDSCTTEGRTDGYRWCGTTEDYDRDKKYGFCPETAMSTVGGNSEGAPCVFPFTFLGNKYESCTSAGRSDGKMWCATTANYDDDRKWGFCPDQGYSLFLVAAHEFGHAMGLEHSQDPGALMAPIYTYTKNFRLSQDDIKGIQELYGASPDIDLGTGPTPTLGPVTPEICKQDIVFDGIAQIRGEIFFFKDRFIWRTVTPRDKPMGPLLVATFWPELPEKIDAVYEAPQEEKAVFFAGNEYWIYSASTLERGYPKPLTSLGLPPDVQRVDAAFNWSKNKKTYIFAGDKFWRYNEVKKKMDPGFPKLIADAWNAIPDNLDAVVDLQGGGHSYFFKGAYYLKLENQSLKSVKFGSIKSDWLGC

SEQ ID NO: 944 - protein, 206 aa, Human [sequence omitted]

SEQ ID NO: 945 - protein, 295 aa, Human
MDNSGKEAEAMALLAEAERKVKNSQSFFSGLFGGSSKIEEACEIYARAANMFKMAKNWSAAGNAFCQAAQLHLQLQSKHDAATCFVDAGNAFKKADPQEAINCLMRAIEIYTDMGRFTIAAKHHISIAEIYETELVDIEKAIAHYEQSADYYKGEESNSSANKCLLKVAGYAALLEQYQKAIDIYEQVGTNAMDSPLLKYSAKDYFFKAALCHFCIDMLNAKLAVQKYEELFPAFSDSRECKLMKKLLEAHEEQNVDSYTESVKEYDSISRLDQWLTTMLLRIKKTIQGDEEDLR

SEQ ID NO: 946 - protein, 781 aa, Human
MAVAEVSRTCLLTVRVLQAHRLPSKDLVTPSDCYVTLWLPTACSHRLQTRTVKNSSSPVWNQSFHFRIHRQLKNVMELKVFDQDLVTGDDPVLSVLFDAGTLRAGEFRRESFSLSPQGEGRLEVEFRLQSLADRGEWLVSNGVLVARELSCLHVQLEETGDQKSSEHRVQLVVPGSCEGPQEASVGTGTFRFHCPACWEQELSIRLQDAPEEQLKAPLSALPSGQVVRLVFPTSQEPLMRVELKKEAGLRELAVRLGFGPCAEEQAFLSRRKQVVAAALRQALQLDGDLQEDEIPVVAIMATGGGIRAMTSLYGQLAGLKELGLLDCVSYITGASGSTWALANLYEDPEWSQKDLAGPTELLKTQVTKNKLGVLAPSQLQRYRQELAERARLGYPSCFTNLWALINEALLHDEPHDHKLSDQREALSHGQNPLPIYCALNTKGQSLTTFEFGEWCEFSPYEVGFPKYGAFIPSELFGSEFFMGQLMKRLPESRICFLEGIWSNLYAANLQDSLYWASEPSQFWDRWVRNQANLDKEQVPLLKIEEPPSTAGRIAEFFTDLLTWRPLAQATHNFLRGLHFHKDYFQHPHFSTWKATTLDGLPNQLTPSEPHLCLLDVGYLINTSCLPLLQPTRDVDLILSLDYNLHGAFQQLQLLGRFCQEQGIPFPPISPSPEEQLQPRECHTFSDPTCPGAPAVLHFPLVSDSFREYSAPGVRRTPEEAAAGEVNLSSSDSPYHYTKVTYSQEDVDKLLHLTHYNVCNNQEQLLEALRQAVQRRRQRRPH

SEQ ID NO: 947 - protein, 309 aa, Human
MDEKVFTKELDQWIEQLNECKQLSESQVKSLCEKAKEILTKESNVQEVRCPVTVCGDVHGQFHDLMELFRIGGKSPDTNYLFMGDYVDRGYYSVETVTLLVALKVRYRERITILRGNHESRQITQVYGFYDECLRKYGNANVWKYFTDLFDYLPLTALVDGQIFCLHGGLSPSIDTLDHIRALDRLQEVPHEGPMCDLLWSDPDDRGGWGISPRGAGYTFGQDISETFNHANGLTLVSRAHQLVMEGYNWCHDRNVVTIFSAPNYCYRCGNQAAIMELDDTLKYSFLQFDPAPRRGEPHVTRRTPDYFL

SEQ ID NO: 948 - protein, 538 aa, Human
MARAAALLPSRSPPTPLLWPLLLLLLLETGAQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGGIIGGIIAAIIATAVAATGILICRQQRKEQTLQGAEEDEDLEGPPSYKPPTPKAKLEAQEMPSQLFTLGASEHSPLKTPYFDAGASCTEQEMPRYHELPTLEERSGPLHPGATSLGSPIPVPPGPPAVEDVSLDLEDEEGEEEEEYLDKINPIYDALSYSSPSDSYQGKGFVMSRAMYV

SEQ ID NO: 949 - protein, 435 aa, Human
MSSHHTTFPFDPERRVRSTLKKVFGFDSFKTPLQESATMAVVKGNKDVFVCMPTGAGKSLCYQLPALLAKGITIVVSPLIALIQDQVDHLLTLKVRVSSLNSKLSAQERKELLADLEREKPQTKILYITPEMAASSSFQPTLNSLVSRHLLSYLVVDEAHCVSQWGHDFRPDYLRLGALRSRLGHAPCVALTATATPQVQEDVFAALHLKKPVAIFKTPCFRANLFYDVQFKELISDPYGNLKDFCLKALGQEADKGLSGCGIVYCRTREACEQLAIELSCRGVNAKAYHAGLKASERTLVQNDWMEEKVPVIVATISFGMGVDKANVRFVAHWNIAKSMAGYYQESGRAGRDGKPSWCRLYYSRNDRDQVSFLIRKEVAKLQEKRGNKASDKATIMAFDALVTFCEELGRWGRGHGKSLRAAWCSQVVSRHAEL

SEQ ID NO: 950 - protein, 650 aa, Human
MASNMDREMILADFQACTGIENIDEAITLLEQNNWDLVAAINGVIPQENGILQSEYGGETIPGPAFNPASHPASAPTSSSSSAFRPVMPSRQIVERQPRMLDFRVEYRDRNVDVVLEDTCTVGEIKQILENELQIPVSKMLLKGWKTGDVEDSTVLKSLHLPKNNSLYVLTPDLPPPSSSSHAGALQESLNQNFMLIITHREVQREYNLNFSGSSTIQEVKRNVYDLTSIPVRHQLWEGWPTSATDDSMCLAESGLSYPCHRLTVGRRSSPAQTREQSEEQITDVHMVSDSDGDDFEDATEFGVDDGEVFGMASSALRKSPMMPENAENEGDALLQFTAEFSSRYGDCHPVFFIGSLEAAFQEAFYVKARDRKLLAIYLHHDESVLTNVFCSQMLCAESIVSYLSQNFITWAWDLTKDSNRARFLTMCNRHFGSVVAQTIRTQKTDQFPLFLIIMGKRSSNEVLNVIQGNTTVDELMMRLMAAMEIFTAQQQEDIKDEDEREARENVKREQDEAYRLSLEADRAKREAHEREMAEQFRLEQIRKEQEEEREAIRLSLEQALPPEPKEENAEPVSKLRIRTPSGEFLERRFLASNKLQIVFDFVASKGFPWDEYKLLSTFPRRDVTQLDPNKSLLEVKLFPQETLFLEAKE

SEQ ID NO: 951 - protein, 905 aa, Homo sapiens
MASESDTEEFYDAPEDVHLGGGYPVGSPGKVGLSTFKETENTAYKVGNESPVQELKQDVSKKIIESIIEESQKVLQLEDDSLDSKGKELSDQATASPIVARTDLSNIPGLLAIDQVLPEESQKAESQNTFEETELELKKCFPSDETCEKPVDETTKLTQTSSTEQLNVLETETEVLNKEAVEVKGGGDVLEPVSSDSLSTKDFAAVEEVAPAKPPRHLTPEPDIVASTKKPVPARPPPPTNFPPPRPPPPSRPAPPPRKRKSELEFETLKTPDIDVPKENITSDSLLTASMASESTVKDSQPSLDLASATSGDKIVTAQENGKAPDGQTVAGEVMGPQRPRSNSGRELTDEEILASVMIKNLDTGEEIPLSLAEEKLPTGINPLTLHIMRRTKEYVSNDAAQSDDEEKLQSQPTDTDGGRLKQKTTQLKKFLGKSVKRAKHLAEEYGERAINKVKSVRDEVFHTDQDDPSSSDDEGMPYTRPVKFKAAHGFKGPYDFDQIKVVQDLSGEHMGAVWTMKFSHCGRLLASAGQDNVVRIWALKNAFDYFNNMRMKYNTEGRVSPSPSQESLSSSKSDTDTGVCSGTDEDPDDKNAPFRQRPFCKYKGHTADLLDLSWSKNYFLLSSSMDKTVRLWHISRRECLCCFQHIDFVTAIAFHPRDDRYFLSGSLDGKLRLWNIPDKKVALWNEVDGQTKLITAANFCQNGKYAVIGTYDGRCIFYDTEHLKYHTQIHVRSTRGRNKVGRKITGIEPLPGENKILVTSNDSRIRLYDLRDLSLSMKYKGYVNSSSQIKASFSGSEDKYVYIWSTYHDLSKFTSVRRDRNDFWEGIKAHNAVVTSAIFAPNPSLMLSLDVQSEKSEGNEKSEDAEVLDATPSGIMKTDNTEVLLSADFTGAIKVFVNKRKNVS

SEQ ID NO: 952 - protein, 765 aa, Homo sapiens
MSGDHLHNDSQIEADFRLNDSHKHKDKHKDREHRHKEHKKEKDREKSKHSNSEHKDSEKKHKEKEKTKHKDGSSEKHKDKHKDRDKEKRKEEKVRASGDAKIKKEKENGFSSPPQIKDEPEDDGYFVPPKEDIKPLKRPRDEDDADYKPKKIKTEDTKKEKKRKLEEEEDGKLKKPKNKDKDKKVPEPDNKKKKPKKEEEQKWKWWEEERYPEGIKWKFLEHKGPVFAPPYEPLPENVKFYYDGKVMKLSPKAEEVATFFAKMLDHEYTTKEIFRKNFFKDWRKEMTNEEKNIITNLSKCDFTQMSQYFKAQTEARKQMSKEEKLKIKEENEKLLKEYGFCIMDNHKERIANFKIEPPGLFRGRGNHPKMGMLKRRIMPEDIIINCSKDAKVPSPPPGHKWKEVRHDNKVTWLVSWTENIQGSIKYIMLNPSSRIKGEKDWQKYETARRLKKCVDKIRNQYREDWKSKEMKVRQRAVALYFIDKLALRAGNEKEEGETADTVGCCSLRVEHINLHPELDGQEYVVEFDFLGKDSIRYYNKVPVEKRVFKNLQLFMENKQPEDDLFDRLNTGILNKHLQDLMEGLTAKVFRTYNASITLQQQLKELTAPDENIPAKILSYNRANRAVAILCNHQRAPPKTFEKSMMNLQTKIDAKKEQLADARRDLKSAKADAKVMKDAKTKKVVESKKKAVQRLEEQLMKLEVQATDREENKQIALGTSKLNYLDPRITVAWCKKWGVPIEKIYNKTQREKFAWAIDMADEDYEF

SEQ ID NO: 953 - protein, 1682 aa, Homo sapiens; identical to SEQ ID NO: 639

SEQ ID NO: 954 - protein, 429 aa, Homo sapiens
MGLYAAAAGVLAGVESRQGSIKGLVYSSNFQNVKQLYALVCETQRYSAVLDAVIASAGLLRAEKKLRPHLAKVLVYELLLGKGFRGGGGRWKALLGRHQARLKAELARLKVHRGVSRNEDLLEVGSRPGPASQLPRFVRVNTLKTCSDDVVDYFKRQGFSYQGRASSLDDLRALKGKHFLLDPLMPELLVFPAQTDLHEHPLYRAGHLILQDRASCLPAMLLDPPPGSHVIDACAAPGNKTSHLAALLKNQGKIFAFDLDAKRLASMATLLARAGVSCCELAEEDFLAVSPSDPRYHEVHYILLDPSCSGSGMPSRQLEEPGAGTPSPVRLHALAGFQQRALCHALTFPSLQRLVYSTCSLCQEENEDVVRDALQQNPGAFRLAPALPAWPHRGLSTFPGAEHCLRASPETTLSSGFFVAVIERVEVPR

SEQ ID NO: 955 - protein, 576 aa, Homo sapiens; identical to SEQ ID NO: 928

The invention claimed is:

1. A method for identifying markers for systemic sclerosis (SSc), the method comprising the following steps:
   a) bringing serum samples of at least 50 SSc patients into contact with more than 5000 antigens coupled to fluorescence-labelled beads, measuring the binding of the individual antigens to proteins in the serum samples of the SSc patients by immunofluorescence assay, and determining the median fluorescence intensity (MFI) for each individual antigen;
   b) bringing serum samples of at least 50 patients with lupus erythematodes (SLE) into contact with the same antigens coupled to fluorescence labelled beads, measuring the binding of the individual antigens to proteins in the serum samples of the SLE patients by means of immunofluorescence assay, and determining from this the median fluorescence intensity (MFI) for each individual antigen;
   c) bringing serum samples of at least 50 patients with early rheumatoid arthritis (RA) into contact with the same antigens coupled to fluorescence labelled beads, measuring the binding of the individual antigens to proteins in the serum samples of the RA patients by means of immunofluorescence assay, and determining from this the median fluorescence intensity (MFI) for each individual antigen;
   d) bringing serum samples of at least 50 patients with ankylosing spondylitis (SPA) into contact with the same antigens coupled to fluorescence-labelled beads, measuring the binding of the individual antigens to proteins in the serum samples of the SPA patients by means of immunofluorescence assay, and determining from this the median fluorescence intensity (MFI) for each individual antigen;

e) bringing serum samples of at least 50 healthy individuals into contact with the same antigens coupled to fluorescence-labelled beads, measuring the binding of the individual antigens to proteins in the serum samples of the healthy individuals by means of immunofluorescence assay, and determining from this the median fluorescence intensity (MFI) for each individual antigen; and f) statistically evaluating the MFI data of each individual antigen from a), b), c), d), and e) by means of univariate analysis and thus identifying markers with which SSc patients can be differentiated from patients with SLE, patients with early RA, patients with SPA, and from healthy individuals;

wherein the markers are selected from the sequences of SEQ ID NO: 1-7, 9-11, 15, 18, 22, 26, 27, 30, 40, 44, 46, 48, 72, 75, 77, 83, 85, 92, 102, 104, 107, 108, 115, 123, 134, 137, 138, 140, 147, 150, 200, 213, 224, 229, 257, 261, 290, 292, 293, 295, 297, and 309.

2. The method according to claim 1, wherein the markers after univariate statistical analysis have a threshold value of p less than 0.05 and a reactivity in the SSc group modified 1.5 times with respect to the control group, and wherein the control group comprises the patients with SLE and/or patients with early RA and/or patients with SPA and/or healthy individuals.

3. The method according to claim 1, wherein the markers for SSc include SSc subgroups of diffuse SSc (dSSc), limited SSc (lSSc), and SSc overlap syndrome (SSc-OS).

4. Markers of SSc in the form of fusion proteins, wherein the markers are selected from the sequences of SEQ ID NO: 1-7, 9-11, 15, 18, 22, 26, 27, 30, 40, 44, 46, 48, 72, 75, 77, 83, 85, 92, 102, 104, 107, 108, 115, 123, 134, 137, 138, 140, 147, 150, 200, 213, 224, 229, 257, 261, 290, 292, 293, 295, 297, and 309.

5. A panel of markers for SSc comprising at least two different markers attached to a solid substrate selected independently of one another from the sequences of SEQ ID NO: 1-7, 9-11, 15, 18, 22, 26, 27, 30, 40, 44, 46, 48, 72, 75, 77, 83, 85, 92, 102, 104, 107, 108, 115, 123, 134, 137, 138, 140, 147, 150, 200, 213, 224, 229, 257, 261, 290, 292, 293, 295, 297, and 309.

6. A diagnostic device or test kit comprising at least one marker in the form of a fusion protein for SSc as defined in claim 4, wherein the SSc subgroups comprise diffuse SSc (dSSc), limited SSc (lSSc) and SSc overlap syndrome (SSc-OS).

7. A method for identifying subgroups of SSc patients, for diagnosis of SSc, for differential diagnosis of SSc or SSc subgroups, for distinguishing SSc from lupus erythematodes (SLE), early rheumatoid arthritis (RA), or ankylosing spondylitis (SPA), for diagnosis of dSSc, lSSc or SSc-OS, for prognosis of SSc, for therapy control in SSc, for therapy monitoring in SSc, and/or for aftercare in SSc, comprising:

a) bringing a bodily fluid or tissue sample from an individual to be tested into contact with at least one marker as defined in claim 4;

b) detecting an interaction of the bodily fluid or tissue sample with the at least one marker; and c) determining an autoantibody profile based on the interaction detected in b) that is indicative of SSc or SSc subgroups.

8. A composition or a pharmaceutical composition for specific application in SSc or SSc subgroups comprising at least one of the marker in the form of a fusion protein as defined in claim 4.

9. A method for screening active substances for SSc, comprising:

a) bringing a substance to be tested into contact with at least one of the markers as defined in claim 4;

b) detecting an interaction of the substance to be tested with the at least one marker; and c) identifying active substances for SSc based on the interaction detected in b).

* * * * *